United States Patent 11,549,145 (METHODS AND COMPOSITIONS FOR INHIBITING AND TREATING NEUROLOGICAL CONDITIONS) - sequence listing, part 57

SEQ ID NO: 1337 - DNA, 9336 bp, Homo sapiens
aggtaaacagcaaacttggaaattgaactgctacaaaatgacaatatggccactattcttaatgagtaaggagaaccttaaaaccccactggaaaattgggtgaagaagaccaggcatggtggcttatgcctgtaatcccagcactctgggaggccaaggtgggtggatcacctgaggtcgggagtttgagaccagcctgaccaacatggagaaaccccgtctctactaaaaatacaaaattagccaggcatggtggcacatgcctgtaataccagctactcgggaggctgaggcaagagaatcgcttgaacctaggaggcagagattgcagtgagccgagatcacaccattgtactccagcctggacaacaaaagcaaaactctgtctcaaaaaaacaaaagaaagaaaattgggtgaagaaaatggacaattcacacagaatacacatgactataaacatacaaaagatccaaccttgctagtaatcaaatccatataaatagaagacactttttgcctttcaaattaacttaatcatgagagggtacagtaaaacttgtatccttgtatgtccctccataataccatacatggtataaatttctacaatttttagaatataatctggtgctatgtataaagaggctttttaaaattcataccctttgactcagtaattctccttctaaaaatctatcttaaggaattaattagaaaggccaatgtttatctacaaagatgttcattgctggacagtggctcatgcctgtaatcccagcactttgggaggctaaggcaggaggatcacttgagcccaggagtttgagaccagtctgggcaacaaagggagacccccatctctacaaaaaataaaaaaattagctgggcatggtagcacacacttgtggtcctagcttctcgagaggctgaggttggagaatcgcttgagccctggagttcaaggctggcaatgaactatgattacaccactgcactacagcctgggtgacagagcaagactctatctcaaaaaacaacaaaaagatgttcatcactgcattatttatagtaatgaaaaattagaaactgcctcaatgtctaaagggaatcatggcacatccatgtgatgttaaattatgcaaccattaaaggtgatgatttcattatatttaatgacatggaaaatacaattaaatgacatggaacattacacatatttaacattacatggaacatccatataatgttaaattatgcaaccattaaaggtggtgatttcattgtatttaatgataaggaaaatacaattaaaatgtaaaattcaagagctcaggattacatgcatagtattattagccaaattttataaaacacatatctacaggggaaaaaaagtgttaaaatcagccaaaatacttattgtttcctctggataccatgatttatagatggttttaattgttttcattccagtaaaatacatgtaacaaaatttaccactttaacaattttttagtgtataattcagtagcattaagtactttcacaatattaggtaacctatcactactataattttccagaattttttctttcatcttccaggactttttcatcttcccacactgaagctctgtacccattaaacaatacctccctccccattgccccttactctcagcctctggtaacgtctgtggcactttctgtcgctcacaaatctgcctagtctaggtacttcatacaagtggaatcatattatattttccctttgtctgggttatttcacttagcacagtgtttttaaggttcacccatgttgcagcacgtatcagaatttcattcttttctatggctgaataatgttccattgtacataacttaaatatcccattttgttcatccattcatctgttgatggacatttgggctgtttcccctttttaactactgtgaataatgctatgaacagtgatgtacacatttatgttcacatccctgcttccagttcttctgagtatatactgaagagtgaaattcctggatcacatgatatttctatttttaatttttggaggaatagttggttttaaattttttaaattttcttgtgtgttgtggaaagtcagggaccccgaacggagggaccggctggagccacagcaaaggaacatgaattgtgaaaatttcatggacatttatcagttcccaaataatacttttataatttcttatgcctgtctttactttaatctcttaatcctgttatcttcataagctgaggatgtatgtcacctcaggaccactgtgatatttgtgttaactgtacaaaatgattgtaaaacatgtgtgtttgaacaatatgaaatcagtgcaccttgaaaaagaacagaataactgatttttagggaacaagggaagacaactataaggtctgactgcctgtggggtcaggcaaaaagagccatatttttcttcttgcagagagcctataaacggatgtgcaagtaggagagatatcgctaaattcttttcctagcaaggaatattaatattaataccctgggaaaggaatgcattcctggggggaggtctataaacagctgctctgggagtttctctcttatgtggttgagataaggattgaggtattccctggtctcctgcagtaccctcaggcttattagggtggggaaaaactccgccctggtaaatctgtggtcagaccagttctctggtctcaaccctgttttctgctgtttaagatgtttatcaagacaatacggggggggggaggagccaagatggccaaataggaacagctccggtctacagctcccagcgtgagtgacgcagaacacaggtgatttctgcatttccatctgaggtaccaggttcatctcactacggagtgccagacagtgggcccaggtcagtgggtgcagcgcaccgtgcgtgagccgaagcagggcgaggcattgcctcactcgggaagcacaaggggtcagggagttccctttcctagtcaaagaaaggggtgacagacggcacctggaaaattgggtcactcccacccgaatactgcgcttttccaacgggcttaaaaaacctcgcaccaggagattatatcctgcacctggcttggagggtcctaggcccacggagtctcgctgattgctagcacagcagtctgagatcaaactgcaaggcagcagcgaggctgggggaggggcgcccgccattgcccaggcttgcttaggtaaacaaagcagccgggaagctccaactgggtggagcctaccacagctcaaggaggcctgactgcctctgtaggctccacctctgggggcagggcacagacaaacaaaaagacagcagtaacctctgcagacttaaatgtccctgtctgacagctttgaagagagcagtggttcttccagcactcagctggagatctgagaacgggcagactgcctcctcaagtgggtccctgacccctgagcagcctaactgggaggcaccccccagtaggggcagactgacaccccacatggccgggtactcctctgagacaaaacttgcagaggaacgattagacagcagcatttgcggttcacgaaaaaccactgttctgcagacaccgctgctgatacccaggcaaacagagtctggagtggatctctagcaaactccaacagacctgcagctgagggtcctgtctgttagaaggaaaactaacaaacagaaaggacatgcacaccaaaaacccatctgcacatcaccatcatcaaagactaaaagtagataaaaccacaaagatggggaaaaaacagaacagaagaaccggaaactctaaaaagcagagcacctctcctcctccaaaggatcacagttcctcaccagcaatggaacaaagctggatggagaatgactttgacgagttgagagaagaaggcttcagacgatcaaactacgagctacaggaggaaattcaagccaaaggcaaagaagtcacaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaatagaaagaaacgaacaaagcctccaagaaatatgggactatgtgaaaagaccaaatctacgtctaattggtgtacctgaaagtgacagggagaatggaaccaagttagaaaacactaaaagatattatccaggagaacttccccaatctagcaaggcaggccaacattcagattcaggaaatacagagaatgccgcgaagatacttctcaagaaaagcaactccaagacacataattgtcagattcaccaaagttgaaatgaaggaaaagatgttaagggcagccagagagaaaggtcgggttacccacaaagggaagcccatcagactaacagctgatctctcggcagaaactctacaagccagaagagagtgggggccaatattcaacattcttaaagaaaagaattttcaacccagaatttcatatccagccaagctaagcttcgtaagtgaaggagaaataaaataccttacagacaagaaatgctgagagattttgtcaccaccaggcctgccctaaaagagctcctgaaggaagtgctaaacatggaaaggaacaactggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaagttggataaagagtcaagacccatcagtgtgttgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagctagtcctgagtgacctacaaagagacgtagactcccacacattaataatgggagactttaacaccccactgtcaacattagacagattaacgagacagaaagtcaacaaggatacccaggaattgaactcagctctgcaccaagcggacctaatagacatctacagaactctccaccccagatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaaactcactcaaaaccgctcaactacatggaaattgaacaacctgctcctgaatgactactgggtacataacgaaatgaaggcagaaataaagatgttctttgaaaccaacgagaacaaagatacaacataccagaatctctgggacacattcaaagcagtgtgtaaagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcaacacatacactcttccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaacaaaaaagagaattttagaccaatagtcttgatgaacactgatgcaaaaatcctcaataaaatactggcaaaccaaatccagcagcacatcaaaaagcttatccaccatgatcaagtggacttcatccctgggatgcaaggctggttcaatataagcaaatcaataaatgtaatccagcatataaacagaaccacagacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctactgaacgggcaaaaactggaagcattccctttgaaaactggcacaagacagggatgccctctctcaccactcctattcagcatagtgttggaagttctggccagggcaattaggcaagagaaggaaataaagggtattcaattaggaaaagaggaagtcaaattgtccctgtttgcagacgacatgattgtatatctagaaaaccccattgtctcagccgaaaatctccttaagctgataagcaacttcagcaaagtctcaggatacaaaatcaatgtacaaaaatcacaagcattcttatacatcaataacagacaaacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatattgtgaaaatggccatcctgcccaaggtaatttatagattcaatgtcatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaagacagcatggtactggtaccaaaacagagatacagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaacacttaaacgttagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaaaagcttctgcacagcaaaagaaactaccatcagagtgaacaggcaacccacaaaatgggagaaaattttcgcaacctactcatctgacaaagggctaatatccagaatccacaatgaactcaaacaaatttacaagaaaaaacaaacaaccccatcaaaaagtgggcgaaggacatgaacagacacttctcaaaagaagacatttaggcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacacacacacgtatgtttattgcggcactattcacaatagcaaagacttggaaccaacccaaatgtccaacaatgatagactggattaagaaaatgtggcacatatacacatatgcagccataaaaaatgatgagttcatgtcctttgtagggacacggatgaaattgaaaatcatcattctcagtaaactatcgcaagaacaaaaaaccaaacaccgcatattctcactcataggtgggaattgaacaatgagaacacatggacacaggaaggggaacatcacactctggggactattgaggggtggggggaggggggagggatagcattgggagatatacctaatgctagatgacgagttagtgggtgcagcgaccagcatgtcacatgtatacatatgtaactaacctgcacagtgtgcacatgtaccctaaaacttaaataataaaaaaaaaagacaatacgcgcacagttgaacatagacccttatcagtagttctgttttgccttttgtcttgtttcctcagaagcatgtgatctttgttctgcttttgccctttgaagcatgtgatctttgtacctactccctgttttacaccccctccccttttgaaacccttaataaaaaacttgctggtttgaggctcaggtgggcatcacagtcctactgatatgcgacgtcacccccggcagcccagctgttaaaattcctctctttgtactatttctctttatttctcagtcggccgacacttatggaaaatagaaagaacctatgttgaaatattgggggtgggttcccccaatacttctgtatttttcagattctctttactgagcatatattatttttacaatcagaaaaaaat

SEQ ID NO: 1338 - DNA, 11192 bp, Homo sapiens
tgaatgtttatcccatggctgtttagtttgaccaaaatcatccttctgtctaaatcacaatataaacacatttctaccaaccattttaaattattttttaacttgccatattttttctataaatatgcgagcttaagaaataccatgaaatcataggactagatttctttgttagacaatataaaacagatcttgaccttttcatggcaaaatttatatcatataattttacacctcttgtgcctgaataacaatacattattaaagagtttttaatgaatgaatggataaatgaataaatgtttcaacagaaggcctgagattattgaattaattttatcaacatgtatttatttaaagctatcatcttgcccttattactaaataatagtatggagtaaatacagacttacttaatggctaattggaaagaacttattgtatgtagatatatgttcatttgtttcgcattttattattttaaatacccataaattgaaattaggacttcgttttatttttatacagccttcataatgatgaatgaattttaaataatacatcatctatttatttacatatggattgcaaaaatatattaacgaacatatcttagttttttaagaaaaaaattcatgtggggtaaaggtaaattgatacattcacacaaacaggcaattgttgaatatttcacgtatattatgctattagctatgtactaaatatcaaaatgatttaaaaaatgatgtggggttttgtagaaggaatcaacatgtttggatttatttctcatgggaggttttagacagggctgagatgagaaatacagaaaaataacattattttaaggaaatgttttgatgttgctgagtttgaagtattgttgatcatttaagtaaagcatctattctaatgattagacactgtttagttttatatgtctgtttggttaggctgcattctccggttatttgatccaacactaatctaggtgtttctaggaaggtatttggttgaggtgattaaagtcctgattgtccagcacaagctaggtgggagtgattgaatcagttgaaatgccttaagagtaaaactaaagctttttctgaaaatgaagtacaactatggacatcagagtcaacttatgcccaagagttacagcctgtccttcctgatagcctgccctgcagatttcatacttgccaaataaaccccacaattgcataagccaattccttgtaatctcctgtatatccctggatgaactttgattgttaccgggactttagaatcaaaatccctgattgaaattcatacttcaccacacattagctaatttcaaacaaactaattaaactctcaagtcttggttcctcatttgttaaatattaatagtaacagtaacagtatctgtttcttgggttgttgtgaggattaattgagataatccatattgtattagtccgttctcaggctgctatagagaactgcctgagaatgggtaatttacaaagaaaagcgttttaattgactcacagttccacattgctggaaaggcctcaggaaactcacaatcatgatggaaggcaaaggagaagcatgcaccttctttataaggcagcaggatggagaaggagtgagtgcaagcaggggaaatgccagacacttataaaaccatcagatctcgtaagactcattcactatcatgagaacagcatgggggagccacacccatgatgcagttgcctctacctcgtccttcccttgacacgtggggattatggggatgacaattcaaggtgagatttgggtgaagacacagagccgagccatattacatatcaaagcttattgcataagtagtgtttagcacaaagtatgtacttaatgttagctgccattttcttaaaatattattacttagaagaagatctacaaaagaagacaaatgattgaaactcaggagagacatctagatatggctgaacttagggaccttcaacatatagagtggaagatgacccacagtttgtataggttcattcaactatcaattgaagaatgcataggtgttacccaagagtaaacaagattaatgagtaaatctattcactctacatggaagctaaattccattttataatctccactcataaatatttgttagtgtcttagttgaaaccgtagaaaatatgattaccacattgtatgtaatagaaaataatgtagtttgccttgtgtttaacacaacttaaaactgccagcatctgctttattcctcagtgctttgtttctggaaccacagatctctcttccctaccagtgtccctaataaactatttgtcttgaatacacatttcccagggtcagtttctgcagagacaaatactatgagatggcatttgaaatttggttaagagatcaaaggtatttgttgctcttacttttgggtgatttagaaaaaaaataaaaatactttaaaaaggtgaacatagcttctctactatttcatagataaacacaataatactgtcattcactatatataaccaaagtgtaagttaaaatatttgattctggtgttcttatatataatttaggggagtaggttgctatctgccatttatatctttggattgctcttctgtttggtaaactttcacaatcagtagtaagggtattcccactctcatctgagacagaaaggaaaattccacaaaaaagtactgaaagcaatctgagggttgaggaaatacagaaaagttactgagtcaaatatgatgatatgaagaaacaagcacttgttagtatgactgataaactatcaccttagaaattgagtagaaggtaattgtctccattattttccaagatagaaaccaaatttaaaaagtcaaatttaacaaattttgagttacaagtaaaaaaagctaaacaatcttgtgaaatattttcccaggaaaatgcattaggctttaacgactgcacactgtgtaatggaaagcattcaaatttacctaagaaaaacgttttgtaatgactttatttgttttttataaacctgtgaaatgatcatgtaaaaatttcaaagagatactcccgggtatgatgttgagaggcaattttagcacctattatagaacttcacaatgtaatataacctgttgtgccttactacttaatcacataatggcatttataaattgttcacactgctttgcaaaaatgtcttgccataacactgttacggcaacatgtatttttattgttatttttatgacatgagaaaacatatcaaagcactcaggaaacatcctatgtgagtagccataacagaatcaccaagcaaagcaagaactttgtgaacaaagagtatatgtaatcataagtattattttttcataaaacattgctattataaaatgtgcctatttttaagcttttcaaagactcagttacagaaacattattattgaagcaaggacagtgagactacttactgtcacattttgtatattttcaaacagggaaataaattgataataattttctatatctcagacaaatagcaattatttatcatattctgttattgaaatctataaaatattacaaaatatttatactaaattgcttatattttgatgttatgtataccttatatccctggtgactataaaatgaagttatagataaattcctaaaacgcttaagcaataaaatataagtttgttatatggtaatataaaatcttttatgattttatttataggaacagtgacatggatctggaggagcctatatatggaaaaaaatgtattgaattaattgccaaacatttgtgctttagttttaaaagcacattaccatggaaatcataattccaaagaaatttctttcattacagtttcaaaagaacccaactaaattgtaaaaagtgcctttcataaatctaatcttaagtagttatccttcatagacatatctgcgtattcaaagatggtgagagggttttctttttattattattattattattattattattatactttaagttttaggacacatgtgcacaatgtgcaggttagttacatatgtatatgggtgccatgctggtgtgctgcacccattaactcgtcatttagcattaggtatatctcctaatgctatccctcccgcctccccctaccccacaacagtccccagagtgtgatgttccccttcctgtgtccatgtgttctcattgttcaattcccacctatgagtgagaatatgcggtgtttggttgtttttgcaatagtttactgagaatgatgatttccaatttcatccatgtccctacaaaggacatgaactcatcatttttaatggctgcatagtattccatggtgtatatgtgccacattttcttaatccagtctatcattgttggacatttgggttggttccaagtctttgctattgtgaatagtgccacaataaacatacgtgtacatgtgtctttatagcagcatgatttatagtcctttgggtatatacccagtaatgggatggctgggtcaaatggtatttctagttctagatccctgaggaatcaccacactgacttccacattggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttttggctgcataaatgtcttcttttgagaagtgtctgttcatatcctttgcccactttttgatggggttgtttgtttttttcttgtaaatttgttggagttcattgtagattctggatattagccctttgtcagatgagtaggttgcgaaaattttctcccattttgtaggttgcctgtttactctgatggtagtttcttttgctgtgcagaagctctttagtttaattagatcccatttgtcaattttgtcttttgttgccattgcttttggcgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtctcagctttctacatatggctagccagttttcccagcaccgtttattaaatagggaatctgttgtccaatttcattggctaaacctcttagccttatataaaatagcaatagtgatgaaatgccagatagtactccagaaggccgaatcaggagaactaggtagaagagatgagaatgcatgttttcatttaatataaactagtaaaatttaagcactggaactctttaacaaactgttgttggaagtattcatgctaagtcaaatagagccagaaaaaaataaatgataaatccttaaagttggtttctaactgtgatgaactctatttagttaaaactgcagcttttcagttttttattgcttcatctgaaaatctgaaacagttataccttccagttctaacattctaaaatacctcccaatctcaaatatagtacagttccatgttaagaacataaaaatttagactgaagaagtttttatatgccttgcacagtagccattattttgagaaaaggctgatgggggactttggttccttcctggtagtcttgtgatatttctctttaatctcaacaatgacatgctgtcatgcgattttgacatagtgctgtaccattcccatatgatacactaactggacttaggaaaaaaatcatattgataaatataaactatggtctggttatattcataataaatcatttggagaagggtctgtatttggtacactttctaatattgccccaattgaatgtttgtccattaatagcaatccctgtttaaaagcattttgtttcagccttttagtaatattggaccattgtcttctaatgtccattgttgctaatttgaagaatactgctggtttttttccagtgtctctggggtgatttttaaaaatattttcctagaaaatttttagcctttatcttagttcattttgtgttactgtaagaaaataccacatacagggtaacttatgaagaaaagaaatttatttctcacacagttctggaggctgggaagttcaatatcaaggggctggcatctggtgagagcctttttgtggcatcatcccgtggcagaaggcaaaagggcaggtgaggaaggaaatgagagttacagaaagctaaactcactttattatctctttatgctaacaatgtatgagatgatatcagtgttttactgtggagtttctgattgcctttcttttttcttgttaggtgaataaaggcaagcctacttcccaatattctgagtgtttttttcaataactggaaactaatttgttgtcttattgaacatacagattttcattttaatttgaacagttggctttgtatgtactatgttctcttctacaactttttgtttcttctggagatgcctatgttttttcttttttaaaaaatattttccttctttataaaatgtataagttttctcagtctctcccttgtatttgccattccacagaaaagcctttatttcctagaaaacttttcttttggatttttcttactttcttttccaaagtaaaataagtgtaattttttgttccttttacatggctactgtcctgggactttcctttgacattcacctaggttgaatccattaattatctgattacaaatctaaatcaggggtttccccatataaattattaataaaggttaaataggaagtacactttcaagtacttgtgtgcctgaaaattatctttatcttaatgcttgatggaaagtttgcctgaatatgaaattttaggtttaaattatgctccttataaatttcaaagtaataaaggaacagagaaataaaattatgcagctacttttttgtggggaatttggcagttatgataatggtgcaagacacagatcaatcagttaatgaccatgtagagggcaagtacaaagattcagagaaagaagcagacatttgacagccccatagagctcaagagaccaaaatgataaacttcagggattaggattctgatgagaagactgtaacagagaaatgagtacatcaatctgttaattttattcccaaaacattggctaaattcttaaggattatgaatccttattattgattttctcagcagctccataatgccttcaaacaaatgcatttttatctggattgtctacttctattttgatctggatttttttaaaaacttgttttggcagcagcattgattttttgcaaactactctgtcatacttgaaagtggtaccattgagatcatagacttttttatattggttacagatctactagattctcatgttgtttacagagatttttttacattgattcttggtagttatccaaacatataataataactcataatcatgcctctctcttaacaactgtaatgcatctaatcctttctgttgtccaatttcattggctaagccttttagccttatataaaatagcaatagtgatgataatcattcttgtttttttttttctgacaatagcaggaaagcctctagtgtatccctattaagtaaggtgcaaatttataggggatgaggaatacatacatacacatatgtgtacatgatgatatcatgcttaggaaacacttatcaaattctaatttattgactacttacaacatgaatatgttttgagtcctataacataatccttttgcatcaatgaagttaatgacatgacttctctacatagattaattaagatggtgctatagattgaattgtgttccccttgaatttatatattgaagttctaacccctaatatctcaaaatatgacattatttggagatagggcttttacagaggtaatcattagagtgggccctaaaccaatatgactggtgtcattataaaatggggatgtttggtaacaggcacgcatgcaggaaaagtgccacaaaaatatgaagatatccatctataagccgaggagaaagatctgaaacagattctgtcctcacagccctcagaaggaaccaatcctactgacattttgattttaaactcatagacttcagacctgcgagacagtagatttccattgtttaagccactcaattagtagtactttgtcatggcagtttaccaaaccaatacagatggtaaggacattggcaaaaatggaggagtaaagacttctaacaattctcttcaccatagaagcaatgagaaaactaacaaaaattttcaaaattaacttttctaaaaaactttagatattaatagaggattatagcactctattcaagaatattggctgaatctcagtaacaacagtgaaatttgtggcttttaacctggactattcctatccctctgttagctcttaagtagccttgaaaataaacatcttgcaatcacagagaaaactagaagcctggtatccaatggagacagcagaaagggattggagtgccttcgagatctcattcccccaaaatataattatttgacctatcaggtagttccctgaaagactccatttgcagagctgtcttaagccccttttgcccttggggatcttgtcaaaaacaactggagccaattttttcactctgtgactgcctgaagtggcagataagagttggggcaaacaaaaagcaacacaaagagcttaaaatgaaaactgaggaatgagatttttatggaggctttgaaaatgttgacatactcctgggaatctagacagacacagaaaaatgtgagaaaaccctaagtctgtatctctggctgaacttgaggctttcttcatgcagaaagtgaaacctaaaaaagttttcaaccgtgtaacttaacacagtgttaaagatgtactccagaatgcactcagtgctctgcaacaaagactaggagatctatttttgtacataggcttttaaataaatctctgtataaggagtagattattaataagctaaccaagaagagatttcagtggccacataattaaagaacactgacttcacagatttaggttagaaaagtcataaagtaaacagtaacaataacaaagaaaacataaaccaaaaaccctgagggttgtagggaatccgatattcaataattaccaaaatatactattttaaatatctggttttcaacaaaaactataaaacatgtaaaaaaaaaaaaactataagtgtgtttcctacatggggaaaaactgaaaaactgctcctaaagagtctcagccattagaactactaggcaaagattttcaatctgcgactttaaatatatccatataatgaaagcaattcatatataaagaacgaaaggaaagtataagaataatatctcaccaaatagagaatgtcaataaaaacacagaactttttaaaagaagcaaacagaaatttggacattgaaaattacaataatgaaatggaaaaattcattagagggtttcaatggcaaattttagaaagctggagaacttaacaatatgtcagttgagattatccagcctaagaaacagaaagaagaaaatcaagaaatcaagaaaaaaatcaggaaagaatgaagaaaatcaagaagtctctgaaacctgtgggatattatcaagcataccaatatatggatattggtagttcagaaggacagaagataaagaagcagaaagaatatgcaaagaaataatggctgaaaacttcacaattttgataaaacaaaacaaaaaccactagtctacacatcccagaggctcaataaacccaagtactataatttgtagatatctatgccaaggtacattataataaaactctctaaagccaaagacacagatagtcttgaaagcagcaagatagaagtggcttatcacaaacaagggattctgaataatattatcagctgatttctcatcagaaagcatagaagacagaggaaatttttaaaaagacttttaattaaaaaatttaaatccagcaaaactatcctttaaaaatgaaggaggaaacaaagaattcattactactgaacttgtcatacaagaaacactaaagaaagctcttcagactgaaatgaaaggatgctggcaagtaactagaatttaaatgcagaaataaagggcactgaggaaggtaactaaataaatataaaaataaatatatatttttgtttttaattagtttgaaataaaaaatatattttgtgtaatactatgcaggcataaaaaagaatgagatcacgtcttttacaacgacatgggggattaggaataatggaggccattatcctcagcaagctaatgcaagaacagaaaaacaaatactgcgtgttctcacctataagtgagagttatatgatgagaacacatggacacatagaggggaacaacacacactggggcctgtcagagaatgggaggagggagagggtcaggaaaaaaaaaactaatggatactagacttaatgcttaggtgatcaaataatctgtacaacaaaccctcaagatacacatttacctatataacatgactgtacattttgtacatgtatccttgaacttaaaatgttaaatatatacatgtatatgtatatatataggttgtaatataaaaagttttcaattatttttatcctattcgaattaaaagacagttgcataaagcaatagttataaatctgtgtgaataggtacacaatgcattagaatgcaaattgtataatagcaccaagggtgggggatggaaagaatttatacagaaataattctgtataaaatttaatttggtattaatctgaactagattatgttaaattaagatattaattgcaatccgcaaggaaaccactaatttttttactctccacctatagtaaaagaagcaacaagggaattacaacagtattttagaaaatatctaaccatgataataaattttattaatcaattttttaacattgatgcatttctggagtaaat

SEQ ID NO: 1339 - DNA, 17429 bp, Homo sapiens
aggtaaacagcaaacttggaaattgaactgctacaaaatgacaatatggccactattcttaatgagtaaggagaaccttaaaaccccactggaaaattgggtgaagaagaccaggcatggtggcttatgcctgtaatcccagcactctgggaggccaaggtgggtggatcacctgaggtcgggagtttgagaccagcctgaccaacatggagaaaccccgtctctactaaaaatacaaaattagccaggcatggtggcacatgcctgtaataccagctactcgggaggctgaggcaagagaatcgcttgaacctaggaggcagagattgcagtgagccgagatcacaccattgtactccagcctggacaacaaaagcaaaactctgtctcaaaaaaacaaaagaaagaaaattgggtgaagaaaatggacaattcacacagaatacacatgactataaacatacaaaagatccaaccttgctagtaatcaaatccatataaatagaagacactttttgcctttcaaattaacttaatcatgagagggtacagtaaaacttgtatccttgtatgtccctccataataccatacatggtataaatttctacaatttttagaatataatctggtgctatgtataaagaggctttttaaaattcataccctttgactcagtaattctccttctaaaaatctatcttaaggaattaattagaaaggccaatgtttatctacaaagatgttcattgctggacagtggctcatgcctgtaatcccagcactttgggaggctaaggcaggaggatcacttgagcccaggagtttgagaccagtctgggcaacaaagggagacccccatctctacaaaaaataaaaaaattagctgggcatggtagcacacacttgtggtcctagcttctcgagaggctgaggttggagaatcgcttgagccctggagttcaaggctggcaatgaactatgattacaccactgcactacagcctgggtgacagagcaagactctatctcaaaaaacaacaaaaagatgttcatcactgcattatttatagtaatgaaaaattagaaactgcctcaatgtctaaagggaatcatggcacatccatgtgatgttaaattatgcaaccattaaaggtgatgatttcattatatttaatgacatggaaaatacaattaaatgacatggaacattacacatatttaacattacatggaacatccatataatgttaaattatgcaaccattaaaggtggtgatttcattgtatttaatgataaggaaaatacaattaaaatgtaaaattcaagagctcaggattacatgcatagtattattagccaaattttataaaacacatatctacaggggaaaaaaagtgttaaaatcagccaaaatacttattgtttcctctggataccatgatttatagatggttttaattgttttcattccagtaaaatacatgtaacaaaatttaccactttaacaattttttagtgtataattcagtagcattaagtactttcacaatattaggtaacctatcactactataattttccagaattttttctttcatcttccaggactttttcatcttcccacactgaagctctgtacccattaaacaatacctccctccccattgccccttactctcagcctctggtaacgtctgtggcactttctgtcgctcacaaatctgcctagtctaggtacttcatacaagtggaatcatattatattttccctttgtctgggttatttcacttagcacagtgtttttaaggttcacccatgttgcagcacgtatcagaatttcattcttttctatggctgaataatgttccattgtacataacttaaatatcccattttgttcatccattcatctgttgatggacatttgggctgtttcccctttttaactactgtgaataatgctatgaacagtgatgtacacatttatgttcacatccctgcttccagttcttctgagtatatactgaagagtgaaattcctggatcacatgatatttctatttttaatttttggaggaatagttggttttaaattttttaaattttcttgtgtgttgtggaaagtcagggaccccgaacggagggaccggctggagccacagcaaaggaacatgaattgtgaaaatttcatggacatttatcagttcccaaataatacttttataatttcttatgcctgtctttactttaatctcttaatcctgttatcttcataagctgaggatgtatgtcacctcaggaccactgtgatatttgtgttaactgtacaaaatgattgtaaaacatgtgtgtttgaacaatatgaaatcagtgcaccttgaaaaagaacagaataactgatttttagggaacaagggaagacaactataaggtctgactgcctgtggggtcaggcaaaaagagccatatttttcttcttgcagagagcctataaacggatgtgcaagtaggagagatatcgctaaattcttttcctagcaaggaatattaatattaataccctgggaaaggaatgcattcctggggggaggtctataaacagctgctctgggagtttctctcttatgtggttgagataaggattgaggtattccctggtctcctgcagtaccctcaggcttattagggtggggaaaaactccgccctggtaaatctgtggtcagaccagttctctggtctcaaccctgttttctgctgtttaagatgtttatcaagacaatacggggggggggaggagccaagatggccaaataggaacagctccggtctacagctcccagcgtgagtgacgcagaacacaggtgatttctgcatttccatctgaggtaccaggttcatctcactacggagtgccagacagtgggcccaggtcagtgggtgcagcgcaccgtgcgtgagccgaagcagggcgaggcattgcctcactcgggaagcacaaggggtcagggagttccctttcctagtcaaagaaaggggtgacagacggcacctggaaaattgggtcactcccacccgaatactgcgcttttccaacgggcttaaaaaacctcgcaccaggagattatatcctgcacctggcttggagggtcctaggcccacggagtctcgctgattgctagcacagcagtctgagatcaaactgcaaggcagcagcgaggctgggggaggggcgcccgccattgcccaggcttgcttaggtaaacaaagcagccgggaagctccaactgggtggagcctaccacagctcaaggaggcctgactgcctctgtaggctccacctctgggggcagggcacagacaaacaaaaagacagcagtaacctctgcagacttaaatgtccctgtctgacagctttgaagagagcagtggttcttccagcactcagctggagatctgagaacgggcagactgcctcctcaagtgggtccctgacccctgagcagcctaactgggaggcaccccccagtaggggcagactgacaccccacatggccgggtactcctctgagacaaaacttgcagaggaacgattagacagcagcatttgcggttcacgaaaaaccactgttctgcagacaccgctgctgatacccaggcaaacagagtctggagtggatctctagcaaactccaacagacctgcagctgagggtcctgtctgttagaaggaaaactaacaaacagaaaggacatgcacaccaaaaacccatctgcacatcaccatcatcaaagactaaaagtagataaaaccacaaagatggggaaaaaacagaacagaagaaccggaaactctaaaaagcagagcacctctcctcctccaaaggatcacagttcctcaccagcaatggaacaaagctggatggagaatgactttgacgagttgagagaagaaggcttcagacgatcaaactacgagctacaggaggaaattcaagccaaaggcaaagaagtcacaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaatagaaagaaacgaacaaagcctccaagaaatatgggactatgtgaaaagaccaaatctacgtctaattggtgtacctgaaagtgacagggagaatggaaccaagttagaaaacactaaaagatattatccaggagaacttccccaatctagcaaggcaggccaacattcagattcaggaaatacagagaatgccgcgaagatacttctcaagaaaagcaactccaagacacataattgtcagattcaccaaagttgaaatgaaggaaaagatgttaagggcagccagagagaaaggtcgggttacccacaaagggaagcccatcagactaacagctgatctctcggcagaaactctacaagccagaagagagtgggggccaatattcaacattcttaaagaaaagaattttcaacccagaatttcatatccagccaagctaagcttcgtaagtgaaggagaaataaaataccttacagacaagaaatgctgagagattttgtcaccaccaggcctgccctaaaagagctcctgaaggaagtgctaaacatggaaaggaacaactggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaagttggataaagagtcaagacccatcagtgtgttgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagctagtcctgagtgacctacaaagagacgtagactcccacacattaataatgggagactttaacaccccactgtcaacattagacagattaacgagacagaaagtcaacaaggatacccaggaattgaactcagctctgcaccaagcggacctaatagacatctacagaactctccaccccagatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaaactcactcaaaaccgctcaactacatggaaattgaacaacctgctcctgaatgactactgggtacataacgaaatgaaggcagaaataaagatgttctttgaaaccaacgagaacaaagatacaacataccagaatctctgggacacattcaaagcagtgtgtaaagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcaacacatacactcttccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaacaaaaaagagaattttagaccaatagtcttgatgaacactgatgcaaaaatcctcaataaaatactggcaaaccaaatccagcagcacatcaaaaagcttatccaccatgatcaagtggacttcatccctgggatgcaaggctggttcaatataagcaaatcaataaatgtaatccagcatataaacagaaccacagacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctactgaacgggcaaaaactggaagcattccctttgaaaactggcacaagacagggatgccctctctcaccactcctattcagcatagtgttggaagttctggccagggcaattaggcaagagaaggaaataaagggtattcaattaggaaaagaggaagtcaaattgtccctgtttgcagacgacatgattgtatatctagaaaaccccattgtctcagccgaaaatctccttaagctgataagcaacttcagcaaagtctcaggatacaaaatcaatgtacaaaaatcacaagcattcttatacatcaataacagacaaacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatattgtgaaaatggccatcctgcccaaggtaatttatagattcaatgtcatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaagacagcatggtactggtaccaaaacagagatacagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaacacttaaacgttagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaaaagcttctgcacagcaaaagaaactaccatcagagtgaacaggcaacccacaaaatgggagaaaattttcgcaacctactcatctgacaaagggctaatatccagaatccacaatgaactcaaacaaatttacaagaaaaaacaaacaaccccatcaaaaagtgggcgaaggacatgaacagacacttctcaaaagaagacatttaggcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacacacacacgtatgtttattgcggcactattcacaatagcaaagacttggaaccaacccaaatgtccaacaatgatagactggattaagaaaatgtggcacatatacacatatgcagccataaaaaatgatgagttcatgtcctttgtagggacacggatgaaattgaaaatcatcattctcagtaaactatcgcaagaacaaaaaaccaaacaccgcatattctcactcataggtgggaattgaacaatgagaacacatggacacaggaaggggaacatcacactctggggactattgaggggtggggggaggggggagggatagcattgggagatatacctaatgctagatgacgagttagtgggtgcagcgaccagcatgtcacatgtatacatatgtaactaacctgcacagtgtgcacatgtaccctaaaacttaaataataaaaaaaaaagacaatacgcgcacagttgaacatagacccttatcagtagttctgttttgccttttgtcttgtttcctcagaagcatgtgatctttgttctgcttttgccctttgaagcatgtgatctttgtacctactccctgttttacaccccctccccttttgaaacccttaataaaaaacttgctggtttgaggctcaggtgggcatcacagtcctactgatatgcgacgtcacccccggcagcccagctgttaaaattcctctctttgtactatttctctttatttctcagtcggccgacacttatggaaaatagaaagaacctatgttgaaatattgggggtgggttcccccaatacttctgtatttttcagattctctttactgagcatatattatttttacaatcagaaaaaaatgaacggatttattttcaaatgccccccattgctcttctttaaatatacagaatatattctttacatataaaacactgctccttcagagccaagcaaaggatcactcattttccccttaactgagaacaagggctgcacatgaacaaaacgcctgctttaaaatgtacccatggctggatgctgtggctcacacttataatcccagcactttgagaggctaaggtgggtggatcacttgagctcaggagtttgagaccagcctgggcaacatagcgaaactctgtctctataacaaatacaccaaaaattagctaggcatggtggtgtgtgcctgtagtctcagctatttgcaaggctgacgtgggaggatcactagagcccaggaggtcgaggctgcagtgacctgtgattacaccactgcactccagcctgggagacagagtgagaccctctctctcaaaaaaaaaaaaaaatgtacccatatttgttttcatcaggtatggtaagatgacagacacagagaaaactatctctgcaagaagagtttgttatgcagttcccaggaggagaggtgtgtcacgccttgcagggccacacaggaagaacttgggtcagccaagaagcagagggggtgagggaaaagcacgatccagcgcctttaatgtagtttccagcagaaaggcaaggcaaggcagggaagcaggcttaggattggctaatctgtataactttggcaggccctggctatagggattgtccctagttgtcccatgcctggccctggagtgatttagggcagggggaatattggcttgctgtgtcagagtttgataaaggaggtgactgggggtgtgggctctggattgactggtttgcatacgaaaggcacgctcgaccaagttgtttactctctccccaaagtagctagccctgggaggggcagtctctccaggataatgcattataaaaacaacaacagcacctgattagtataatgacatatgtttctcttcacagcagtttgtaatagcaaaggttggaaaccgttgaatgggatttccatcacataaagaactggttatgtaaattatgttacactgatacaatccaatgagcctcccttcagagagaggcaccctcatggcctaattacttctttaaggaccccatctcaatactatcacattggcaataacctgaattttggaagggacacattcaaaccatagcagagatgtaatcaaattaagatgaaatcattgggctgggcctaagccaatatgactggtgtctttataagaagagggaaatttggacatagacctatagacacagggagaagatggccatgtgacaacgaggcagagactgcagtgatgcatctatatgccaggcaacgccaagaaattcctcatgaaggaaccaaccttgccaacactttgattttagacttctagcctccagaaccgtaaggtgataaatttctgttgtttaagccacccagcctgtggtactctcttacagtagccctcctgactaatataggccctttctcaactttccctagaagcccaggtttccttgctacaaccctggcagaggctttggcacatttcacccctcctctctttgtgattggttttcacaaagaagctcaaagtggaggaatgatctctggacatgaagcctgaggaccatgcaagctccttcctgccagaggctctgttctgggttctacctgacctggactctgagggctctgagcagggaagggttagaacccagcgtggatcaaacatttgagatgaatcagcactgatagctggaatgtgagctcccaagtggcttgagctcactctgctcaggaccctctgcagctcctgggggaacactggcacagacgggtgcacagttaatattcagttaacaccggctggctgaatgaagggcgagctatcttgagcctgacttttctgatccttcaatgagcatgctaacatcatccaacccctgaccttgtggtgaggatcaaagacgttaatgcccactaaacgctttctacgatgcctggaaacaactgttatcaatactgtgctatgttttagtaaagagggctgttccctgagagcaaaattggcaagtgggtctcacctcccatgctgactccaattgttgggtgcggttgcatggattgatgtcaaaagcctcccaaggcccagtctgggccagatgcagggactgtcatgatcccttagcagtgtttgctctggaaaaggaggaacagggacctgggtgccatctcttcacagcgctccacccctagggcctgcttaaatggcacagccagctcctcagagagacaggacacactctccttctgcctgcagttgtgaggaaagaaggggcactgaggaggatgggtcaccccgggagcagagcctggctcatatcctggtatccctgcagaggctggaggtggggccagcaccacctgaggacatgtagccttcccaggattctggcgtgtgttcccatccctagcaggaaagaagtggaaattagccaatcaccctggaagtgggcaaccagtctttctcccctttcctgtgaattcactcaggacactggggacaaaagacatcacagaccctatctcccgtgctcttttacagtggctatttcatttagtactagggggctttttgcctgtattttataaatgagcaaagaggactggagggtctgagtgatttgtccagggtcatcctctgtcctttggcttttacctgtgtcaccacagcctcctggggagatggctgtgaaagtgggcaaagggtgagtctcagcttcacagggctgcagcatcagcagcctctcttgcctgtccgtcagcactgacaggggcaacacctggcctggcacaaggctctccgcttcttgccctcaggacttggagtctcttggaaggagcctcagcccttctcttggttcctgcttttgtctctagccttcctagagtagctcagatcagttcacacccctctacccacgactacccaggaaaggacatgatccctcattaagacccagctattgcctaagggtcactgagggcctcaaaccccagaggctctgtggcaggcacctgggagcccacttggcgggccttgccctggcccagacatcacagaccactctcactgcactggctattaagtgcctgctctctactagggattcctagggggtggccaagagaaggaaagacacccccacaggaaggatgggcccagaaactgactttccatggctccgacgaggggtcctgaggcactctatcgaagtgcaagtccctgaatctgtgtcccaagctctgaaaatgcaagaggtgcttggagcaaacagggagtgtcctgtcactgaaggtctgcaagcagaggggtaagggactgtttgcctcctacagatttcccttctttctcttcttctgggcctctgggccagagacaggcattttacttgatgcgatcatcctcagcacatgcctgacacatagtaggtgctcagtaattgttagctgttgttattaaccattatgtgagtttagagtgcccgtcctattgcagagagggagagagcagagacaaatggtgattctaagaacctgtccccttccctgggactcactccagtggctggtcgccagttgcacccacacgcggctggctgcgggcaggagagctgggctcattcgttctggcagctgtccctgcagatgaggatcgagggtatgtgactgcctgagcagctacttcaatcctaatgtccctttaatagctctcgtcaaattgccacagctctccccagagattttcatggctatggaaaataaatagccattatctgacctccaggggaatgaagatgtctgcagaattcggggaaaagcagttataaaactgagtagagccagcgcaccctttccctattagcaacctctaagggagtcctagctactgcctaggaaatcacaaaataaatgtattcactcctcagactctcttttttcacctattagtatgtatatgagtacatttggcttgtggtagatcaggagagagaaagaaagaaaaaacaactacaaaaatatgtaatgattagttagtccaggggtagcaggaaaagaagctggtcaagtaaagggtttaatccttttttatttttattatttttttagacagggtatcacgctgttgcccaggttggagtacagtggtacaaccatagctcactgcagcctcaaactcctgggctcaagcaatcctcctgccccagcctcccgagcagctgggactacagtgcacaccaccacacaaggctaattttcaaattttgggcagttttactatgttgcccaggctggtcctgaactcctggcctcaagggatcctcccatctcagcctcccatagtgctggggttacaggtatgagccaccaagcccagctggaagtttttaaaacgtttcaacattcaaagaatgtgagaatgaaaatgcccttccttttcttaccacctaatttggaaaagagaaactatttttttaatcccaaaaacatttggtatagctggcaaaaagtgttctgttcttatatatgagacagttcctgaaataggccctagagacagcactcacggccaagtgggaccttgctctggtactagctcaggtggccaaggggtttcaggagagggtctggacttccccacatcctgctttcatcagctctaagactaggtggtgacatctgcttctcaataaccttcaccaggcttgctgtgaaggtcacctgagataagagacgtgaaaggatgctgaagatgcaaaagcctaagccaggcagccctgcttggcctggcctcctggaaaggggcaatgccccagcccagcacacaaccagggcctcatgatgacaattctgcaaaactggtccttggctcgtcctcccttgccaggatgagactgtgcaaagccccacccacaggcagctgctccaggtgtcgtttaagggctccaaattccttccaactaaaagtatctttccatccctgttggtatagtggttaggggaaaaaaaattaaaagaaaatgaacaatgtattttccacgtcaagatgcctgaacttcccataacagctgtcactttaagaagccataagagaaagggccaggtctccataggtcattattcttcccaggcggggtcaacttcctctattaacacccatgcacgtatcagaagctacccatgaaaggccaagggcctacagcaaagctcccatgactggaaagtatttaagcataaggaacagaatagtttcgagggaaggataagaaagagagtcgggaaggctgggcagaacactacttggacaactaaaaaagcaagtggggacatctcaaagagtgggctggccactcccagaacctgtgtaagcaggaaacaaaaagcatttattgctggtaaatgcttaacaactggctctctgggataaaaatgtatatatgtacagaaatttattataaatttcattgataaaaatgatgtgcagcacataatttataaataaaatatacaatgccatttattgtaattctagaaaagttttttacagaatgcttttgttgatttttgctgactcttctatccaacctgtttgcaattcaaccatgatatgacacaaccagactacaaataaatgtttgttactatctgattcaacaaagcagtcactcatttcatggaatggatatgggctgttactcagtgaaaagacacatgagatggttcagtgctaactcacccttctgacagaaaatgccagaaagtttccaccccattgacaggcttggagtcttgagtaccatctgggtgggtggagctggcactggcacgaaacctctccactgctatcctgacagagatggggcatgtacttcccagggccacttgccaacccagggaggttttccatcttgctggtttggtgagggaggctgctttcagatttcaagtggacactgctggcctggatagggctgaggggctctgcctccaagaggtgttcttcgctttgtggcattacctctctgaagtactttagagtactttacaggcctgctttactcctcagaatcctgctgcagagctgagggctggataatttcatgttctctggcaactgatggccactgtggtaccagaggagggatgtatgtctgggcactttcaaaagtatgttattagaaagttgcgcatcacggccgggcacggtggttcatgcctgtaatcccagcactttgggaggccgaggtgggtggatcacctgaggtcaggagttcgagaccagcctggccaacactggtgaaaccccgtctctaccaaaaatacaaaaattagtggggcgtggtggcgcacgcctgtaatcccagctactccggaggctgaggaagaactgcttgaacctggggggtggaggttgcagtgagctgagatcatgccactgcactccagccctgggcaacaagaatgaaactctgtctcaaaaaaaaaaaaaaaaaaagaaagttctgcatcaatcctgttgtctcactgtaaatagcataagaacaatgttctggcccctccctccacttgagttgccaggttctacgacagggtcttccccaccatggaccagaatacaagatagcattttttctgcagtagtatccaaagcaaaaatttcatcagaaggatggcattggagtctctttcagttgaaaagtgcatgcagacaattgagtgtcagatccaggggagaggaaaaggcggcagagaactagggagacaggtcgagagtaaggagatgaagggacatttgagactctgaattttttctttttttgtagaggtgggatcttgctatgttgcccaggctagtcctgaactcctgggctcaagtgattctcccactttgacctctcaaagtgctgggaatataggcatgagccaccatgccaagccgagggaagctgtttcttacagctgggtttcttgcacatccagacttcacatcccgccttgtgcatacagactgggagtcccttgggtagcgggggacaggaatgggattggctttggccatgaggcagattaagcaacacctaaggggagttgctagtggaccaaggcccagaccacaatgcaggggagagggagaaaaggggtggaagagtgacaggaactgatatttttttagcagttactatgagaggaataaaactggacaggaaagaaagagaaaatacataaaacaaggacaggttgttcggcatctcttcaggagatgactgtctggtacatcctttaccaccattatcctcaatcaccaatcactaagcattgccatgtaccaggcccaggggctgggactatgggagctagttcttatagtggctcatgatctacttgggaaggcaagacctaaagaaatgacaagtaagccacaatggcatatgctttgtcgaatgagagggtaccaatcagcgagtgtgccggggacttagaggaaggggtcacaatgccctgggatggctgaggtccccacggagatgttgggccttgagccagaacttgagtgctggataacacttgagtggaaaggaggggcacagagactgtccagattggaatggacaaggcatagcagaaagtacggtggtacactcaaggcactgtgaacagcagtttattattattttttccttcatgctgtcttttggggtccttaggaaatgactctgttgtccttcacaagcccagctaggccctggaacaaatggcctttagagagttcaacagtatgaaactcctactacgagtaaatcaatgttaggtgttgtggggtatgtggaaaagtgaaaaaataatagtccctgccttaaaggacaagaaatgattttccctttatcaaatgtccagggaaggaaactgtgggatgacactgtggcagtgaagtctcacatctgataaaaggcagtgggctctgggc

SEQ ID NO: 1340 - DNA, 877026 bp, Homo sapiens; identical to SEQ ID NO: 50

SEQ ID NO: 1341 - DNA, 299839 bp, Homo sapiens
actccgcgccacccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccaggtccgtggtgctgcagggcagggggaagcgggctgacagatgctgggctgcagggccgcagatgccctggcattgcttcttgccaaagactcgcctcagttcctgagacccccagtgtgctggacgtgcctacttttcaggcaggcccaggctgaggcgtggcgggacttgaaacacagttagaacgtagatgtggtattctacattgctttcttggctttgggttatttatcaaatagattgaagaaaagcaaaacacgtggaagccttatctccgtaaagaggcagcgtttttacatttttaaacgttcagcgtatcctgctagaaaaatttcaatttaagcaatgtgtctttacaattgttatcagtagtagtaggtaaatgtctccatagtgaagatgagcagaattagaaaagaaagccctcttaattgcaaaccccagattgtttttgcttttacagtgtgatgatggagatggcttatttaaaacggctttttattattattattttttaaagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcaggtattataggatattaattctattcctgattaagaacttatgccaacagacaagtgcacactattgaaattatagttttgtgttttaaaaatttatttgtgaagttcctaacatgtgattccttagtttcaggagttggtagcgggtagacgcttagattttggagttagacaaaagtaggtactagccgggtctcccaccccttaactcaggaaaaagtggtcagattgtacagcaaatcttcagttcacttaactgtaaaatggagataacttctttcataagatggttattcaaattgcacaagctaaccacttagcttagtgtttactagtgttcaataattggttgctgttatttttaaaacatctagtaactttttttttttgtttttttttttttttttgagacggaatctcgctctgtcacccaggctgtagtgcagtggcgcaatctcggctcactgtaagctccgcctcccggggttcacgccattctcctgcctcagcctcccaagtagctgggactacaggcgcccaccaccacgcccggctaattttttttttgtatttttagtagagacggggtttcaccgtgttaaccaggatggtctccatctcctgatctcgtgatccgcccgcctagccctcccaaagtgctgggattacaggtgtgagccatcgcgccctgcctactagctcatttttccccatttttatcagaagggaattctggaagaatttgtcagatgttttggaaaagttaagatttaccaaatattgtatttgtggtggatcactaatccattactatttgatagataccatattgttaaaaaaaattaataatctgttcttaatgaattcatgtgctctcctgcacatttttcctttctttcctaaaggtttacaatccatctggttgtttttaaaatttagaagctcttagtttttggttctagaaccttttggagtacatttttcagttttcagtggtttgaatccttttgcatgctctgtgattacttgaactggataaggatggaaggtgttttcatgattgtagccataagttctttgcgttttgtaatttgttgggtctgtaggctggcacttgtttaagattgtttgtttattatttttagttggaagatgattgttgccatgaaatgtgaaagcatttaaacaggaaaatgtatgagaaagtgtacaacatgtgacacgtaatgggtgcttcagtaaatgtccctttctcactttttttctgttaacattataccatctgtcccgaaaagctggcccatactttttcataacagctctgtgagcatatctaagtcttaaaaataggttatttttatgtaactctattggtattattaatatatttcttttccttatatgtatttattcctgcctcaaactacttcaaaatacttcccatttgaatatacatgctagagatgttttagattagaatgatgacatttgactaatgcaaatatgctcagtgattctattgtttaaatgtaggaagaacctaactctaaaatgaattgccctctgaaagtttctgccttaaagttgtattatgtgtaacctatcttgtacctgaaattcagaattttgtaacttataaaaacgaatttatcaagtctttgccctaggctaagtattttacatgcaatatttcgtttaatcctgatcacagttatgaagtaggcattgttttcattttatagaagagaaaacagacttatgggtaaaataacctactcaagagtacacaatagaaggtggcagagctgggatttgaaccaggtctgccttaaaaatttatgctcttaactagttttaagaaaataaccctgacatagtttataccattgttctgtaaggaaatgtgattcacattatgagcgcctatttgttgatcagtctttgaattgtgttactcttctcggatgtagcatattcctattgctggtctaaagctggctttgggactactgctttccttctttatgggattcgtcagcataagcagtttgggaacacattttactctcttaccttttacccttttcccttccctctgtgcacagtagtccagcctttcatatacatgagtatttatgaattagatacttggaactcctgcaatatcagcatttatttttaaaaggcagtaggggcaggatgcggtggctcatgcctgtaatgccagcactttgggaggctgaggtgggaggattgcttgagccagggcaacatggcaagaccctgtctgtaaaaaaaaaaaaaaaaaaaaaaaatgagctgggtgtggtggtgcccacctgtggtcccaactccagcctgggggacagagcatagtaatcataaatgaaaggcaatgagattgtgtacattttttaaaataaaaagacaatttttctataaaatatggttttgaaaataattgaattatatattaacatgattttaaaaaattaagtggattatttgaacaaaattgtaacagaaatggatttttaaaaatgttagttttgggacatgcatctattgcatttattggcaaattacttttttacttttctttttactttctgtgttcctccatgtgcttgctctttacaagtaagggatatatgttcaaaatttatatgcttaggttattacatgaaaatattaaaattacatgaaattattaaaaattacatgaaaatattaaaagataaaatgaattttaatagaaggaaagttactaaattcaattactttttttgtttcttacagtgaatcttgcacttgcactagcagcgaacgattcggtaggtgtttattaatagaaatattaatttattaaaatgtttttaaggcaatgataaagagcatattggtgttttttatttactctgtcagaagctatagtgtagttgtagtgagttgcatatctttaaggaactcaatgctgccatcactactggttacatttaataataataatgtatttaagtgttgaccatatattgtttgctatatatcccacaagaggctttgatgttctttatatcctaaaccaattttgcctttatgatttacagaagcattattctgggttcagtttttaagtgttagggattaagtttttttaaggggaaagatattctgaaagtagtgtatatccattaaaacaaaattcaaatggaatacgtgtgtaatgcaaaactgaaagtttatgcattcctttctgttccagagaattaacttaggctatagttctatgtatatcctttcagctcttcctttctccatataaaaatctaaaacaatgtacatgtatgtgtgtgtgcatacatctttccatgatgtgcctcattcttaatggctggtgcattaatggtcaatgataatatatttaaccagttcccatttgatgaaatatttaggttgggtcccattttttccctactctaaacgatgctatggtggagttcttaaatagtattcttatatactaagtgatgacatttttgtaggatagattcctaggagtaaaactactaggtcaaaagatattcctactttaaattgtactcctaaaagtttgcttgtaaaaaatttcagttccattcttttccttgggagaagaaaaaaaaattcagctatagtctatgggagtatcaatttttcatagtctcattattgttggatgttatctttttagatattaaaaaaaataacattcaacttatttgcaactccataaattatcagctactaaatgaaaaggcacacacgtatttcagaattgattttaatttctgcttcatacctattttatagaatacaggcaagaatcatttaatatgtttaactgtggctatacttctaacttattttctacccgtactatgtaacttcagttcctaataaatagcacatatgaaaaaataatatgtggtatctctgtaagtatgttatcagtatatggagtccagaatctgccagatcctggaactagacatagatattcatgtcttctgatgcttggctgtatatttctgaaaattggaaactaataaacaagatttataatattttggttatgtaaattttattcaccatagaaacaggtagcataaaaggacttttagggaagaaaatgtaattaagtttctctaaagttgcgcttctagaaagagaagattcaaatatcaagacaaaattttttcttaaaaaattttttttcaacttgcttccttttatgggggacctactttcatgtatcccatcttatcctctttcttgaattcttttttttgtttttctgaaggacacccttgagtccttatatggtttggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaaggtacgtaattctgccaacaccttaattttagctcattgagatctctttggacttctgtgataatattttatagaagtaggaaactaatacatataggaagtaaatttgcttatttctttaatttccaaaagtgtctttaatttatattcgttatttgatagcttaactagattctagttaactataaaattccaggttcaaaataatttcctctctgaactttgaaaacaacataccgtttttttctagcatgctaatgaaatgtctgatgatagtctgattcatgttcttttgtaataaccagtgttttccctctcaaagagtttaggttttctttatgtcttttacatttaaaagtgccacaaacatgcgtctagttattggcttaacctgcgtgggatttggccctgcagtatcaagctttgagtatttttcagcataggaaaaatttcttctgctcattgattatgttttgtgatgtgtttgttctgtctccagaaacctgttaggtagatactgacctttatgcttgttaatttttctgtcatattttgatctctttgtcttttgctctgtgttttgaaagatgtctttgactatttttcacattgctgtattggactttagttgttattaggttcttctgattttgtttttcatttggaaattatttttttttccaatttttccagaactatttcttattttccacttgctgttccaaaaaaaaggttgtaccattctcttgaatctctccgaggatgctaattgaaattaataaaaagtgtttttcttagtgacctctgcttacttaggatggttcttgtaatgtggctgttgaccagcagaatcagctttacctgggaacttgttagacatgtaaaatcttgagccccaccctaggcttactgaatcagaaaccctggggatagagatctgcaatctgtgttttaaccaaccctctaggcgattttgatgcatgccaaagttaagaaccatggatctagaattttccacttctaacctgctaatgtcaccctcttttgttttctagtgtggttatggttttatttagttttagactattttgtttccttgtcatttcaatggaatttggaagagaagggagataaacatatatgtttaggcaaccgtattgagataagagccagtaatatggtttttttcctagtgattttaatgacagcacttagttaccctagaaaaaggaccctgtcttccttaaggaaggaaacggaaaattcaatggatgggaaggtagataaatttgtaggtgtggacctcttttaatttggttatcattgcagccaaagctttgagtcttatagataatgtgaagtaactatgtaataagggatccaaggatgaaaaaaacagttaactcatttcctgtttagaaaaaaaaagtgcagctcgctgccagcacttatttaactttacataaacacgcccttcgaggctgaaccaaatctgactgattttcaatgtgaaaataaaatataaaaactcttcttggagttatttctaaacagaactaacattagaattctctgaatcatcagaattgtctatttcagaaaaattggattcatcaaatgaatcttcggccaacaactgtttgaggatgatattaccatcacactcaggaatgctacgttttctaggatttgacattttcagtgattgagaattactatattttgtaaattgaaatgctgctactaaaaatagaatgctataaatagaatgatgtcttttgtttccaaagttgatatactagagtgatgtgaaaataataataaaagcaagatatttcatggagtggcaagatctaataagataaggttgtaggcctaggggaaacaggtccaggaagcaattcattttacttttcatgttgtacttagtaatatctgaagtggattgcgtaagccctggggagatttgcaagacagtccattgggatgtgggcagaacatttttcttttctatttgaattaatttttattttaatatttgtttgtatataccttatatatggtattagtatagtagctctaatataatgtataaacaaatatattaacatattgaggatgtatgcccaaataccttttaaaaaactgattggggtacatgatcagaaaagtttgaatgtcactggtctaggctaaaggaatttctgggctggaccatatgcctagttcaaaagaagactacctctaccttgtagattgagttttttttgtttttgtttttgtttttgttttttaagatctcgatctgttgcccaggctggagtgcagtggtgtgatctcagctcactgcaacctccgcctcccgggttcaagtgattctcatgcctcatcctcctgagcagctgggattacaggtgcccgccacaacacccagctaatttttgtatttttaatagagatggggtttcaccatattggtcaggctggtctgaaactcctgacctcaagtgatccacccacttctgcctcccaaagtgctggagttacaggtgtgagccaccatgcctggcctgcattgaggttttaaaagcattataggaatagggtgtagatttttcctgctttttccttgccttttatactttcctttgaggatgtggatgggtagtattgcagagcaaaatttggggatcatgtgtactatgcatataaatattgcaacccatggtgtgcctgagccagtgcatactggcttgtgacagctgattgttaaattttcggtgaattttgcagaccaactcgtatcatgttgttagcttgaaataggcccatgatgggaatatttaaaccatggaaattggcaaacactgaaaatcaagcccactaccccaagccagttgttagaccttaatggtacccactgatcttatatattgacaatcttattttttgatttttcttttttctctttcttaaaaacatccttattatggatctcattcttttacggcaaaaatttgatgcacagtttggaagagcactgagactgggagagggaaacttaaagaccatcagaaaccattgataagctctgtgagattcctaagtcagttcatttcagttcattttagttcagcaaacatttattgagcacctctaacactcattgccagacaccggcagaaagtaaagaagaataaacatatactgtggaagcttatagcctgctaagattacattcacaaatgtttagtctatataaatatgttgtatatttatataagtgtatgtctgtgtttatgtgtctatatttttttggtatatagttgaaattggtttaatagtttcttttgtgagaaagtttaattaaagcaacatttaataaggttttattaatattgcttcataacagagtagacaccagtgtactcttaaaggttttataatctgataaggacaaaaggaagacaaatgttttaaaatgatgagatatattcagtgtcaaatatagtagtaaatctgcccaagatgagtagcttttattccagagtaaagcagtattgttttaagtagagcattttcatgaacataattatatttgattctcacagaaacctgtaatgcaatccacatagtatttatcagttttacagtctttattgattctcccctaatatccttgccacatttcatcagcaagcaaatatcccttttcctatctctacaatatttttccagtatgttcccattgttctatttccactgttcctattttaattaaggcacgtgctacttttgggtcattcattcatttatacctcaaacaattatagagtgcctactctgtcccaagtgctgtgttagttctgaagatacaaaaatgaatgagacacagaatccctgcctttgaggaactcatagactagcatcccactgcaatgaccttttacctgcccgtacttagttaaatccttccagtacatgatgccagacttctctcactattgaaatcacatactcccttgctcagagtcatagctggatgcttttgctgatattcaatatcctctgccatctggcttcaatctacctttctgggtttatctttagctattcttctaaatggcttctatgctctagctaatctgggttacttgccaaagccagtctaggctggatatactattcttgatagcttacagttattcttctacttgtctactggaatgtttgtgttacctttcaccagctttatgtgtcctatctttcaggcttccttatatggctgtgctggttatatcctgcacaaggatgcttgttgaggggattgagtgatgatagaaattcaggctaccctcctcttgatgtgcacctcttgttctgttgtttatgatctgtcaaaaaaaaaaaaaagatgtgcacccatgggctgctttgtaattcacacaaaggcactgtgtgagctagccttgctcagaagggcagctcagcagctcattgaagtgttccctgaattcctgccaagtgagtgtcttcttctttttttttttttctcactctgttgcccaggctggagtgcagtggcatgatctcggctcactgcaacctctgcctcctgggttcaagtgattctcctgcctcagcctcccaagtagctgggattacaggcaagcaccaccatgcctggctaatttttgaattttttgtagagacggggtttcatcatgttggccaggctggtctcgaactcctgacctcaggtgatctgcccacctcggcctcccaaagtgctgggattacaggcgtgagccactgtgcctggcctggccctttcttcatcttttgaaatccagtaacactgttgatttgtattattattgcactcatgcagccattctgataagttttataataggaaataactaactttcatggagcattcattatgtgtcaagcactgttatatgtgctttccatggactattttaatcttcatgacatggttcttagttcatttactcttcacagcaacgttatgggaataagtactattgtgatccccactgtagttgaggaagcagaaacacctataggttaagtaatttgcctcaagtcacccagaaagtaaatggcagagctaaggttcgaatgccaacctagatcctgtgctcttaacgtacttggtgtattgctcctattttagctagattctttttttttttaattttttttgtgatggagtcttgctgtgtcacccaggctggagtacagtggtgcaatcttggctcactgcaatctccgcctcccgggttcacaccattcccctgcctcagcctcccgagtagctgggactacaggtacccgccaccacacccatctaattttttgtatttttagtagagacagggtttcactgtgttagccaggatggtcttgatctcctgacctcatgatccgcctgcttcggcctcccaaagttctgggattaccggcgtgagccactgtgcctggcctagctagattcttatgattaagaactaggttgtctttattcttggctaccctcagcagctagcgcaatgccttatgacttagaaaatacatggtaaatgtttgctatacgtatgattgtacaggcagatttgaaagtattaagtgtaaagtttcgttttactttattttttgtgagaagtggtatgggatggaggtgtttgttgcgacttagtggcctacacactgttcttttcctgcttcttaaaagatgacgtatggtcatgctttactttatgatgggggtaccttctcagaaatgcatcattaggcgacttcatttttgtatgaactgcgtagagtgtacttaaacaaagctagatagtatagcctactgtacacctaagctatatggtataacctatttgtcctaggctacaaacctgtatagcatgttactgtactgaatactgtagacgtttgtaacacaatggtaagtatttatgtatctaaacaaagaaaagatacagtaaaaatatagtataaaagatacaaaatggtacccctgcatagggcacttaccatgattagagcttgcaggactgatagttgttctgggtgagtcagtgagtggtgagtgaatgtgaaggcctagggcattaatgtacacttttgtacaagtagcacagtaggtttgtttacaccaacatcaccataaacacgtgaatcatgtgttgtgctgtgatgttatgatggctgtgctgtcactaggcaatgggaatcttttagctccattataatcttatgtcaccaccgttgtatatgcagtccattgttgactgaaatgttgttatggggcatatgtctgtattccatgattctacttggccctcttctcattttatactctacctagtgatctcagcttttcccactgctctggttactagtcacgtgcctttactccagatgcatcaccagcttgcatatctctcctgggtactagtctggtctgtctggttttctatggtagatgtgtatttgaatgctttataagcatttcagactcagcatgtgtaaaaccaaactcttcatccctgtgactgtctttgtctcatggaagtctgtctacctatctatgtttttttggtggaatatagctgaaagaatcatacagttacttccattcccaaatcaattacctgttcctgctgcttctgccacttaaagttttatagactgtgtcctgttatttcattccttaatgccactgctttatttggatccatattgtggatcttctgtgatgacttcttttactattattccagcattaggttattcttgttctctattttctctgctatggtgccttgaggaaaggatgaacactttctatattattttataaagtttgtttactatctcctctgctagtctgtgaatatttaggggacaataattttggttttattcctttttttaatccttggtgccttgtccagtaatggaacatagtaggttcttgataaatgttggtagtgactgtggagcatgttaagtgaagagtggccacaaatgaatgaatgagtgagtgaataaataaataaaatatacacagcaaattccaagtgttggataaggtgcctatagttttgttcaatacatattatgctttatttttcactgagcaaatgaagtaattaaaatctgagataatgtgtttgaagcgcttagcacagtggctgacctatcataagtttgaaataaatttttagtattgctagctaaataaaagcttttaagtaatattgcaaaataaatcagtgcacatcttatgtactcaaaaaaaatttttttttttttgagacagagtcttactctgtcacccaggctggagtgcaagtggtacgatctcggctcactgtaacctctgtctcccgggttcaggggattctcgtacctcagcctcctgagtagctgggagtacaggtgtgtgccaccatgttcagttaattttttgtagttttttagagacaagcttttgccatgtttgccaggctggtcttgaactcctgacctcaagagatctgcccgcctcggcctcccaaagtgctgggattacaggtgtaagccactgcgcctggcctactcgattctttccttctttttttttttttttttttttttggagagatggagtcttgctctgttgcccaggctggagtgcagtggcctggtcttggctcactgcaacctttgcctcccgggttcaagtgatcttctgcctcagccttccgagtagctgggattacaggcacatgcccagctaatttttgtatttttattgagatgggatttcaccatcttggccaggctggtcttgaactcctgacctcaggtgatccgcctgcctcggcctctcaaagtgctgggattacaagagtgagccactgctcctggctggcctacttgattcttttagcaacttattttacatttttactgatttttccattgctacaaggaatcattaaccagaattttaattggacttaaagatgggaaagaaagcagttttatcttcaaagagtttatgtttcttctgttatttcttttttattgatgtttatctcaaagcatttatttttttctcatgattacataatgtcttaacacttattcttcctagatgtactgctttttttccccgcaaattattatgagtggttctttaaacataattaagattatctttagccctttgaagttctgtgatcatgtcagaacaaactaagaaattgtaattcaagatttaggttttgatttttgaaaggttcaacagtcttaagtcagaatatattttgtatcaccacttacaacactatgattttcttcattaataaatatgtatatagtatctaatagtccagcatttttgtgtgagatacatctgggcttgattctggctctgcctcctgcaaactctgcgacttttgcctgtacctacctaataacgttgttgtgagtattaaaggaaataactcatgtaaagcacttagcacggtgtctggcatacagtaaatgctaataagagttgttcttattagctccgtgttattataatctggaatattagttatgtgaatttggagtaaatatggatgaaaatatgtttctcacagttacatatggcaaatcctgatgtatactatttagttcaagtttataaggttggaggctcatcttttctttaatacatgtgttgtaaagggattatgctatattaaattaaccaattcttaatacttttattatagcttggaagtaaatacaatacataacatttcttatgaaaaaaattgtgtttcagtattgtggttagccattttggaggaaaggtatgctatttttgtttaaagtatagttattttaaagctagagcagaaaccagggcaaaaggtcagattcagaaggaacaactgcaaaatcattattttttgctttttgcttgtcaattcaaaggcaattcttggtaagaaatgtgttttatatttataagtgcatttgaattcacacatttcatgttcactgagagaggggctcagaaactatatttgtaattataaagcaaaactgtttactaaaactaagaatattttcaggataagaaatggaaatactcattataattgtttaattttgtcgtgaatatttgataattgtgacatctacacacacactttcatatattcatttaccaaatgtttgctaagggcctgtcatctcttaggtgctctgattggcatgggggatacaaaatggaaagagccctgtccttgtccttttcttcatttatttttagagacagtatcttgctctgttggccaggctggagtgcagtagcatgattatagcttactgcagccttgaacccgtgggctcaagcaatcctcctggttcagcctcctgagtagctgggactataggtatgtgccaccatgcttgactaattttttatttttggcagagacaggatctcactatgttgcccaggctggtctgaaactcttgggcttaagtcgtcttcctcctttagcctcacaaagtgctgggattacaggtatgcaccactaggcctacctttatcttagttaatgtatagcctagagactgtttgggagattgttgtttccagtttgctccaggctctctatatggcttgatgattccttaactatctgcagtcttcttgtcatttaccacagatgctcttctaaatcgttcccacttttatcaggtcctctatccaattccaatttccttattcctagcacatggtcttgcttcctattccatgtgaaaaatggacttttcattggtaacttatctggaggcttttcactcacaagtttggtagctgccctgaaatgacatgaaggcttagttcaggtaggattgttgattgcagtgcttttgcatggctgttccatgttgcatggccttcctcagcatggcagcctcagtgtaattggacttacttggtggctgagagctctaaaagttagtgtcccagtgaataaggaggaagctgtatggctttttgtgaccttgccttggtagtcaggctggattagtggttgaagtagttatgtgccttcccacattcaaggggaggagacagacctcccttttgatgggaggggtatcaaaagccttgaaaccttaacatcatccttgtctttcatctctttcatctcacccactctacttctatatatcagtcactaagtgggtttttatttgagaagtatctctttctctccactgtcgtgaacctagctaagaattttatcatctttcacttgagagttttccataacctcttaattggtctgtttaatctcatccaccttgaattaaataatggttcttcatattgattgtagggtagttcttatggcctacaggcctctgctgagattgcttggcttggtttgtttgtttgtttgttttgagatggagtcttactctgtggcccaggctagagtgcagtggcctgatcttggctcactgcaacctccacctgccagtttcaagcgattcccctgcctcagctttccaaatagctgggattacaggtgccagccaccacgcccagctaattttcgtattttttagtagagatgaattttgccatgttggccaggctggtctcgaactcctgacctcatgatccacccaccttggcctcccaaagtgctgggattacaggcatgggccaccgcacctggctgcttggcttagttcttaagggttggattctgcctaattttgcactctgtacttgatgttgttggcactgctcctttacactggctgtcttccttgccttctttgcccagctcctgtcatccttcaggtcttggattggatgtcacttcctctgtggagccaccttagtggtttcaagtaatgtcatttcctcctctattggttcatatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaa

SEQ ID NO: 1342 - DNA, 283308 bp, Homo sapiens
atatgtttatctcatgccattagagtgaccatgactttcacaaggtcggggactgcgtcttaaatcatctgccactattgcctggcccgttgttatgaactcagtaaatggtaagtgattgaaaacagattacactttggcagaattctccaaagttttgaatgcattactgggttttctaaaatgtccataatattaccaaggaatcattttgacttgggagaactatgcttagagaaggttttaggtaagggagtttatatcttgtgcttcaacatttttatttcagttaaaacatatacagcaaaaccccaaaaacttgtttgaactcttattctaatatgccagaaaatttaggaaagtgggcaagtattagatttaaaacaagctttggtaagattaagggctctgagaattgaaatcagaacagttttgttttcggttgtggcattttaaagctttaattttggctgtgaaatatttcacgtgacagatttcattccagcctgtttctttctggtcaggaatgtgtgatggttcacttttggcaattgcactatgtgaaagggcttgggtcagcaccactgtgcagaaatgggtcaatgagcgttcagatgaaagggaaaacacttttaaagaacctttatatattgctgatgtaataagacaaaactcattataagcttgaaactctcaccatgttcttgctttctccttcatctctcaaatgctttgccaaattaaccacatcaactaattttacagaaaatggattgctgaagaagcttcttcagaaagtctctctctcttgtcttccaaaaggacataagtctcctttgtacttctgtaaaaatcttaaaatggccacttaaagagagcgggcagcttgttgtaattcagtgaatgataaagtacaaccgcctatttttcagttgagttgggaggaagaactgtatcctactgttgctttaaaagatgattttattactgtcaggacaaataacaagctaggattttctcagagcaataactgacgagttagattactgcctgtggctcttaaacaatgtaacattcttgaattaaggaaggaaagtactcaggtagtctttgaaggaagtctaggttccctgcatggctatagggttgctgtttcacttttttctgagtagataaggaagcataagccttctccaaaccctggaaaagcctttgctctcaaatttgtgctggaatgttatctggagtgtgatggagccctttgccagtcaccatggaaactgatgaaggctctagttgtcctttgggctatttggggtggcttaaataaaggatgaccaatgcgtctaatcctgttctccacatacgctttttctttaaaaatgattaaaaatacagcttacttaaggaggaaaaggatatctgtatcatgtttctattaggctatttaaaacattgtgtgcagctgaagggtatcccggccaagaaacgttaatgaaaactatcattctggataggcataattccactggtttctgatgttgtctgttagcccccaagctgatatatgcaacagaataacaaatgctaattttccgtttacctacttagtgatggaaaggaacttgtcatagaaatgaagacatgggtagtattttagtatgtcattgccaagtgaaatgcagtttcagtggtggtgtcagacataaaaattaaaagcatctgtgagcaattaaagcattaattattcttattttgcagacatctcatagcacattttccagaatcaccagtccgtagctaaagctagggaaaagaagtcttacggtaatctttagatgtccatattttggcagtccctcctgttcccttaagtggggcacagaggaggaagatctgagcagaaactattaatatctagggtgttacctggtgctgatagaagaatgtttcttaattagttaatttaaaaaattgaggtgaaattcatattgatagagttttggtttgtgagccacactgattgcactgtgaaggatttgttccattttcaaggtctgaccctgattgaaaaggcaaaatgggaacttaagatgattgaggcttgcctcttggttgtttcaaataacatgctttcctttaatgtccaataaaggctatttatatgaaatgaaaatcaaggatataatactcagtgcttctacaaataaggataattttattaattagttcaagattttactgagtactttacatgtgctgtgtgctctttttagtcctagagatgtagtggtaaaatgtgtaagtttctgttcttaaggagtttaagtgtattggaagagacataataaacatatacttttaggtggttataatggttacaaaaaataataaaaaagtgtaaggatgtagaaagtgatgggaggtctgggtgctgtggctcatgcctttaatcccagcaacttaggaggctgaactgggagaattacttcaggcctggactttgagaccagcttgagcaacatagtgagatccccgtttctacaacaacaagtagctgggcatggtggcgtacagctgtagtcccagctactcagaaggctgaggcagatcacttgagcccaggagttcgaggctgcagtgagctatgatcacaccactgtgctacagcctgggcaacagagtgagacccccatctctaaaatataaaaaataaaatgaaagtgataggaggtgcaattttagataaggatgtcagggaggagatctctgaagacatgacatttgagcagacatctgaatgaattgagtaattgggccacaggaagagcaaaagccctgaggtagaatcaacttggattatatgaagtgtttttataaatgggaggaaagcctcatgaacagaataaacaggaagaaggtccatgtgattggagtggtctaggggaaaggtagatagaggcatgtcatgcaaagcctcataagccgtggtggaaatttggatttttttctgtgtacagtgtagtgggtttttcaccagggcagtgacagtctaatttactccttaaaaggatctggctgtaatgtagagaatagagtataggagaataaaaatagaacaagacgactagctagtagctaatgccagtgtgtaagctaaagttgatagcttggactatggtggtagaggtagtgataagtacatctgttccaaagatattttgaagatagagccaggaggacttgctgatgaattggatgtggatggtgaaggaaagagatggttctttttttttttttttttttggtatggtaaaatatgcataatataaaactgaccattttaatgattttaaagtgtgcaattcagtggccttaagtacattaacgttgtgtaaccatcctcactattcatccccagaactttcttatcattccaaactgaaactctattcattaaataataattccccgttttctcctgttcctagcccctagtaaccactaatctactttctgtctcatgaatttgactgttccaactcgtataagtggagtcatataatatttgtccttttatgtctggcttatttcacttagcaaattgttatcaaggttcatccatgttgtagcatatattcaaatttcacttctttttaggttctttggttttgcttttagcaactatgtgaatagtattgaaatttcctgggatggagaagactcttgaaggagaggttaggggttaaaaatcagttctcctttacacatgttaaatgtaaaacgcgtgatagacacccaggtggatatgttgagtaagtctggggcttggaggagaggttggggctggagatttaaatttggatgtcagcatagtataggtggtttttaaagttatgaaactgggtaagtttacctcagaagtaagagtagacttgagaaagtggccttttaactagtacaatttaaagttatgataaaggaatacatatattctaagatgtacacaaattgctaaatttataaaattttaaaagttggcattgatttttaatgttttaattgatatagcacattagttttaagcagttatttgcttgttattttgttagtcaattcgtttactttcattggcttgaaatagtggtaagccttgttttttagtagttctctaagaaattaaaaaaataaattagtgtcaaggtgaattgggtactggctagaatggctgttttcaaaagtcacacatataaattttatcatagtagggacaatttgaaaattagtagatgccatagataataggattaattatgtaaaaattaatttatatgtaaatataaaattaatagataataggataaagggggcttgtttatgaatggagtattctagtgagcaaacaccagctgtgtgtgactaagggtggcacctatccaggggaaggatgttttcaggaaaatttgtgtactttttttttttttttttaacagcagagaggctttttagttagactactggtctcttttcttttccaaaggattaagtttcaaaagaaggatcagaccactcttgtggggtgaaatgggggtggaggaaatatttggaacaagaggaatgtttgcagcaacactggagtagaactttccctagacgctgtggttcataggcatctgaccaagtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaaaaggaaaatttgaagatttagggagtctaccaaatgtcatttttaaaggaggaaattaaagtcaggaaagaacagacttgcttggaaacatgtcctataaatggaacttgagtagctaacatctgcctctgacaaaattccctgcaaggctgctatttttccttgtagtccttgagttagggcactgacattttcatatttgccgtggaaatgattgtgataatataaatgatgttttatttttatacatgattagatagggaagatggaagccagctgtttaaatgcatgtcttatgaaacgctgcaggaaatataacataggcagtagtaaatcaaaggtggcagagagggtattgctgaggctcatgtagcagggatggggcagaaaacctctcttgtttctcttggtgactgctggttttagctcttgcagagttgggtaggttagcccattacatcacacagcatgtggttttatgatttagaggacccaaggcatttctgtaaagcacgtttattaactacctgctatatattagacactgtggtgggaattttggataaaatggtaaataagatagtttgaattatttatttacatctgtgataagtgccacaaagaagtcctgtcctcaggaaagcagataacaggatactgatcctaatctgaggattgagagaagacttcccccagtgagtaatactaattagatctgctttcctacaaccattattactccctatctctaagggcaataggaacaattttaagcatggtataaaaccggtcagattttcttaaaaattactttgctgttgtatggagaatggaggggatgttagagtggatactggagatcaggttaggctattacagtaacctcagcaggaaagagcatggtgatatcttggactggagtgttgacattggaaatggagaaggaggtagaattggtaggtctcggttatagattggatatgggagtggagaggaagggctcaaggatgaccgctattgcaggttcttgactgtacaactgagttgatgttagatatattttcccaatgcatttgaaaataatatgcatattttcaagtttggtacacaaaattgcccttgcttatgaaaattcacaaatgtgttgtgtttttccagtcgtcctttggtcaagatgcaaaaccacagtacttttcagcctttaccgttttacctactattaagtaacctatgtatttgattaaggcttgctaattgtcataattgactgaagttccagcagttttctttttttttttcctgacagggtcttgctttgttgcctaggctgaaggcacccaacttctgcctcccgggctcaagcaattctcctacctcagtcacccaaggagctgggactacaggcatgtgccaccactcccggctgattttttaattttttgtagagatgggttcttattatattgccaaggctggtctttaactcttgggctcaagtgatcctcccaccttggcctcccaaagtgctgggattataggcatgagccattgcacctgacccccagcagttttttaaaaacagttttagagatgtagttcacatattgtgcagttcttccatttgaagtgtacaattcagtggcttttagtatatttacagagttttacatccaccaccaccaatttgagaacattttcattacttccaaaagaaaccccatacccctgaactgtcactccttaattcccccatatacccaagccctaggcaactactaatctactttctgtctctatagatttgcctatttgggatatttcatataaatggaattgtcttaggttgggctactgtaacaaactactgtagactgtgtggcttaaacaacaacttgtttctcacagttctggaggctgggaagtccaggatcaagatactggcagatccaatgtctggttgagggcctgcttcctagtttgcagattaccttctcattttattggattatcacaaagtggaaagagagtgagagagctctttggggtctcttttataatgactctaatcccattcatgaggcctccaccctcatggcctgattatctcccaaaggccccacctcccagtgctttcacattagaggttaggatttcaacatacgaattttaggggacacagatattcagtccacaacaggagtcatacaatatgtgctttttctgactggtttctttcactcagcatgttttcaaggttcatccatgttgtagtgcaggggtgtccaatcttttggctttcctgggccacattggaagaagaattgtcttgggccacatataaaatacactaacactagcgatagttgatgaacttaaaaaaaatcacaaaaaaatcttataatgctttaagaaagtttacgagtttgtgttgggccacattgaaagctgttttgggccacgtgcagctctgaagttgcgggatggacaaacttgttatagtgtatttggtacttcatttctttttattgctgaataatattccattgtatggatggatcatattctgtttatcgatttcatcagtcgatggacattggagttgtttctactttttggctatcatgactcatgctgctatgaacatttgtgtgcaaattttcgtgtgtacgtatgtttcagttctcttagatatatacctagcaatggaattggtgatcatacggtaactctctgtctaactgtttgaggaactgccaggctgctatccatatttctgttctatttcacattcccacttgcagtgtgtgaggatttgattttctctatatcctcaccaatacttattttctgtctttttgattatagtcattctcatggttatgaagggttatcttgtggtttgatttgcatttcctgactgtgtttctgttggactaaaatgttaatgacattgaagctgggaagtttactggctgacatagaatttaagaagtcattttaattcttagagagtacagatgtacagatgaattggcatatacaagtaagtattttcagcattttgtaatgcttaacattatctttatgattctcatttagcaactaacaattaaaacatgttttgtatcttaagttgtacaaggtttgaagtacttgaaaaataattttccttaaacccccaaacacttttgttgcaggttttttcccctttaaacagcaatggtcattcctttggcccctaaacaacacaattgagaatatctaagtgattatggacaaattcagttgaaccaatccaagaaccatctgtgctagacactatgtttatccatggtgctaccctcacaaagcctccagccttgtgaggaagaccgatatattaatacatatttatttacatagaaggaagaatgtggcaagtgcagcagtttgtgggtataaatagtatattaatacgagaacagagagaaattaattccagtcgttcaaaggtaataatttgaaggtgaggtgtggttttggcaggtagaaaaatagcagaagataattctaggttgaaggaactatgtaagcaaagtcatagcaagaaatgacaagatatttggaatgagaactacagaaagtagctcaactagaaagtagtgcggtggagtggcatttctgcatttctgtttgcttaattcttatggtcacaagatggctgccccactgaattgtaaagaggaagaaaaagaatgtgttcccttgttttttatttacaagggaagaaaactctcactagacattttctagattcactgatcaggattggatctcatgaacatcttttagctgcaaggaagactgggaatgtggagaatctgacactttctacctttccagtgggaggtgagttctgcctttgaaaaggaggggtgggttaggagttactgttgggtagtaatatcctctagttgtaaaaaagcaaaggaagagataggttgaatccaggtttgggtaatgaatgaaaaaatggtgatgccattttccaaaatgaattttgcaatctaaaattgaattgggtccttactctattaatgtcacttacttgaatctaactctcagtgtttgggactctataacctcactttctaatcatgaaacctaacggaaaacagaggaggcagctggaagtagtacagtggtttttaaatgctactcttaggactggtgctaacttcctgcataaaaatcacctaggagcttgttaaataaatcaaaatctctgggaattggtatttttaggtctgggatttgaccattagttttgttaacaagttgcccgggtggttctgatacacgtctagggttgggtacttttggtagaaaaagtatgggctatggattctggcaaatctgaatttgattccaactcttcacttattaactgtgtaaacttaggccaggcatttgatctgtcagagctcaggtacctcatttgctaaatgtgtaggaataataataatgataatgcttactttacacagcttttgtgaaatgtagatatatcttatgtgtaatgccactagtataacgcctggcacgtagtgagcattcattaactctggctattattatgtgttagcttacagtaagtatgtgcatttgatttagcatagaaacacaaatttctgtacaactacaacaaaaagaaaagaagcagaatataataaattgcttctattgttgcttactatctgttattttctaggctataacatatgagtcttaattttcttaactgcatttttggctatgtctgtactctattatctatataacttaaaaattggctaatataccaaaaactctaatttttgtgaaatatgctacttaatatttactagaggctatttttcacagtgatctcatgtaaaaccttaaactatacatggttcctgctcttaaacaaaaaacagacaatataaattcagataaaaataataagtgcacattaaggatcattttgttattcttaaagattttatagttgcctgggttaataattagaatgttatttttgatggttgttttgtatgataaataaatacccactgagagtgaatgcttatttttcctgcttccgtgcataaagaggtcttggtgtacagaaaggagaaagatgctaacattgagtacatactttctgctaggaaattaacttaatttgttgtattggcaagaggcagcatgttgtagtgttacctgcagactctgaagccctgttgcctgggttcttatcccattttctgcacttgaactgcctgaccttgggcaagttactaacctttgtgtgccttggtttcttcattgggggttattgtatacctactttatagggttgtcatgaggattaaataagttaaaatatataatgtgtttaggaagtacctggcacatagatagaagtatatgtactgtgtgcatgcactactgttagctattctttaagtttcacaaatttgcagtgctctataatcttcacaaaaatcctataaattagatctctctctcttttttttttggtcttaaaatgtctttattgtattttaaaaagtagatcttcttaatctttacaggtaagaaaattgaggtttgatgaggttaataacttatccataatcacccatctattaagtgatacaaatactagtttgctttttcctgcatcctactatgcctttaatatgttaattttttttttttaaatccttaaaaatagtaatcacccggctgagcgcggtggctcatgcctgtaatcccagcacgttgggaggccaaggtgggcagattacgaggtcaggagttcgagaccagcctggtcagtatggtgacacccctctctactaaaaatacaaaaaaaaaattagcggggcgtggtagcatgcacttgtagtcccagctgcttgggaggttgaggcagaagaattgcttgaacccaggaggtggaggttgcagtgagccaagatcgtgccactccagcctgggcaacagagtgagactccgtctcaaaaaaaaaaaaaaaaatagtaattacccatgtgattcatatggtactaagcaacattttcatttatcaaaaaattgttactacttggcagtggaattaatagattaactctttttgaactttgagtgagatgttaatatttttaaaaagatctgttattgacccttaatttaaaatattgcatcaaggtgtaacagattaaaaaaagtcatattgtaataacaatttaaatgaaattaattccatatatattatttacctgggcttagatgctaacatttttatagcatcattttctaggtaataataattatggtgccttgataatttttcttagtttttgaactttatttttaatttgatagagttgtataataatgtctatatgtgaatacagtacaattgtttatttcactcatgatttagatgacatctgtgattgagtaagttatctaaatcctcaagtttcatacattttatagaaaatataagcaattatgctaatggaaaacctgtaatatatattaacagtattaattgatttgaaacctatgtgtctacctctatggtgtcttttataagaataattcagtgtacagaataagaaacttaacatcacatattaaaatgaaagatgaagtgtttttttaaaaaattaaatgtataatagaggggtgaaagtgtattagattagctcctaaagccaatcttctattaggtatttttccttacctgttttgctcttcctcctcctccacaagcacacacacaccacattcaccctgatcttcagataggtaaaaatcaccaaactgctcccccgtccaacccctgccatattttctgcatggttttaggcacatagcattaggtacaacatgctttgaaatttcccattagaagcagtagcaatattgttagcaatagctctaaggaagctgttggctggatgtttcctcctcagtactctttggtctaccttttaaaaatttctttcagtaaagtgcagcttgctgtcagtaattaattctccttactttgttcaaggaagttgctgaatttgcttatgagttagaatgacaagccttatcctcattttacatatagtatattctaccttagtttccctttatgtgtaacatacaggtggcaaaactactccacatcctttgaatttcattatctgattctgtctaataagaatttatccaaatctttctcacagagcaatccttttttttgagtcagagtctcactcactctgttgcccaggaagaagtgcagtggtgtgatctcagctcactgcaacctctgcctcccaggttcaggcagaacaatcctttttttaaaaaaattatttaccttctttctaacttggctttcactaattcatttttcctctctcattttttttttctatcaggaaattatttcctcccatcccatctccttgaggaacaggaagggcctttaattctcagcggagcagtgttggaagggtcattgaggggaagagagcagagcatatggaactgtgggtttcaaaaccagctgctgggccgctctgattttgagtctgaagggtggatcaagtgctctgttcatatctgatcttataattgcttttctttagaagagctgctctcagaattataaatactcttcccttcattgcagtttagttaaggacattcttaaggaattgatgttagttttccagcatctttgctgcagtactttatttgtttggggaaaggttcttgtttagttaggtttctaggtccccaggctttgattctggcaacaaatgactagttgatatcacagataactatgatttttagagctcagtgtctgtaagcatcttctgcatttttataagcactacatggtggtagaaggcgttctaattttctctgtatttgaagactttacttactaagggcattaaaatcttttattttatttttttaaaaattatacagaccaagatttaaagtttttcttctcttaatcttaggtgttttattcctgatttacttttccctccttactaaatgaaaatgtggcacttaaggcaactgttttcttgttaaagaagaagttgcttctccagttccggaaagaaaaacaaacccagatttgcagcttttttatatttgaaaccctattgtactaaatcttgctagtaagcagataaaaaattttcttctttttggttagctttttcataccatgttgtgactttagttttcaaagatttagacaatgtactttatcactctgtcacccaggctggaatgcaatggtgtaatctctgctcactgcaacctctgtcttccggttttaagcaattctcctgcctcagcctcccaagtagctaggattacaggtgccgccaccatgcctggctaatttttgtagttttagtagagacagggtttcaccatgttggccaggctgctcttgaactcctgacctcaaatgatcctcccgcctcagcctcctaaagtgctgggattacaggcatgagccactgcgcccagccatattttttaataaagccaccatagaaccatagccattctttgtaatagattttctttcatgaagtctattttttttggagttgaggccagtagaaaaaggaagatgatattagattttctggggagaaaatggttgttaggaatagactgcaaagaaatttatgaccccttttaaacaccagaatgtttttaagctatatattattgtataattattatatagtaatattacttaattttgagccctataacttaaagtattagtgtagaagtattagaagagagactttcttgaaatcatagtatgttaaagcttataagagactgtggggatcatatagtaagcaatactgaaattctacagaataacagatggaggtttgttcattcatttattagtttatttacttacccatttattcaacaaatattgagtttttactgttcagaatacttggggatattcctgcccttatggagcttatagtaaatagataacaaacatcccaagtaagttaaatagtatgttagaaggtgatacaagtgaaccgagatggaggaggggtagtgcttaaggattagtgctggtttgcagtttaaaatatgatagtttccattgaaaacatgacacttgagcagagaagagaagaaaatgagagtagactgtgtgactatctgagggaagagtatctcagggagaaggaagagctggggcaaaggccaataggtgggagcatgcctagtataccatgcaaggaatagtaataaggccaatgtgatttctggaggaagaagtggaatggagtaataggtgatgaaaattactaggtttgggaggcaggaggtgggtggggaactgactgggttatgtggggtgaatggttgtaaggactttggcttttacaggaatgaaatgggaggagtggtggcagtgaagggttttgagcagagtaataacacaatctgacttatgtttcatctgaatcattcttgcagccctgttgagaagaaaggctggggtgaggttgtcagatttagcaaataacaaatttgaatttcagataaacaatgaataattttttaatgcatatgtcccgtgcaatatttattgattattcacacataaggcagaatgtttactatgtttttttaaaaaaaaatcatttaaaaaaggacctctttaatgttattgttgattactgtagattattattattatgatcctgctggtcccaaggcttagtagcaaattttcatctctctttcctgtattatctatatttctgtttttcacattgtggtcatcttataccctggagtgctacatatataggttgttggatggcagcccggaccgaatgaatcagaatttctgggatgtaatagggaatctctgtaactacctactcttctaggttctgggtatatagtagtgaacaaagcatgcaaaaatccttaccctcatgggatttacattctagtagaggagatagtaaacaataggtaaatacatttgcactccatatgtgctggttttgcatctgtggatttaaccaactgtggatcaaaaatatttttaaaaacccaataaaaagaacaatacaacaataaaaagtaatacaaataaaaatacagtataataacaatttacataaaatttatattatatttggtattataagtaatctagagatgatttaaagtatacgagaggatgtgtacaggttatatgcaaatactatgccattttatgtaagagtctgaggattggccgggagcggtggctcacgcctgtaatcccagcattttgggaggctgaggcgggcggatcacgaggtcaggagattgagaccatcctggctaacacggtgaaaccccatctctactaaaaataccaaaaaattagccgggtgtgctggggggcgtctgtagtcccggttactcgggaggctgaggcaggagaatggcgtgaacccgggaggcggagcttgcagtgagctgagattgcgccactgcactccagcctgggcgacagagcgagcttccgtctcaaaaaaaaaaaaaaaaaaaaaaaagagtgagggttttggtatgggggcggaggtgtcctggaaccaatgccctgcagatacctagagacaactgtatataatatgttgaatactaatatagatactaagaagaaagaaaaagcagggtggggaataggaaatgtgtagtgttgtggtaagggagttgcaattttagatagcctggccagtgaatgccttactatatggttatgtttaaatcaagacttaaaggaagtgagtaagagaccaggtggatacttgggggaataggatttctggttgagggaatagcaactgcaaaactcctaagtctggagtgttccttgtgtgtttaagaagctgcaagacagtaatatgtatggaatagattagaaaaggggagagtaggagatgaggtgaaagaggtatggtaagtggctggtgattgttgattagtgtttaggcttcatgatacactggagagagacttgggatcctaggcccaggaatggcattatctctgggccttagtttcttttatcactaaaaattagaagactaagatgatctcttaggtttcttcctactcaaaaatagagtctttaatttgaaattgattattggccaggtgtggtggcttacacctgtaatcccagcactttgggaggtcgaggcaggaggatcacttgagccccagagtttgagaccagctggggcaacgtggtgaaaccctgtccctacaaaaaacgaaaaaaaattagctaggcatggtggccagtgcctgtagtcctagttactcaagacactgaggcgggaggattgttgcttgagccaggaaggtcaaggcccctattgccctactgcactctagcatgggcgacagagcaagaccgtctgaaaaaacaaccaaaaagaaatctgccatttatcttgcatttctattttgtacctcttttgagagcagttataaatattttatcatttgggattcttctgtacttttcatgagctcctctcaggttgtgttccaactagccaggtgattttttttttcttttatgctgctgtgttttctcttttttcctgattgaacttgaagatttagacagtcctttgataaacagcaggaaattgttctcttatcaccttgttaaccattagctcttctgacaatcagattcttatttaatcttagctaatagaatttggaaacatatatttttctctactaagagattgaaattcttatgattggcagcttgacataaagctaggcagaaagagaagaaagaagaggcttgaataatttctaaattgaataaacaccaactgccagtccgagattaaactgaatataatatacagggaatcatgggagtcttagctgggtacttctgtagaagtacaacttttaggtaggtcttatttagaaataattgggtgggaacgttctaagatgttgttttgatgggttctattagcagaagacatggataaaaggaacatatcatgaagctttacaatcttatttagtataaattgcattggaagaacaaagcagtatcaaaactgtggttcgtgtctttgaaatccaacacacaaaaataagacgtgtaggctctcaaattgcagctttcttgcagtagtagtgaaacagtataattactcttgaataattctgccaccttttacaacttccacagggtgttacaaattataaacaaatccaaaaaactaattgttatcttggggtttgatctatcttgttttatgtcatctgctagattttgaaatctgtaggagagtcagaaaaagagtatattgttagataccaacattaggttaagtttatggtgacattaaagatgacaatcagactttacaatagtaagtttacagttatttttgctaatagtaattttttttatctgttgtgtatttggtagcttttgtagcaaatattcgtttgaatctggctgaaattgaagaaaatcctaaatggagctttcttgagtaaataaaattattatagaaggagtaagttggaaaggattcataaaacttagctggctggacacccagctgcatacatttatttataggcttttaccttgctcatttatttttctaacagtgtaaaactggaagtttaaagtgaaagactatttacatacttaaaataggagcctatttaaaaataacggagtcaattatgaaaaacaaatgaagtttatttggcaccttttgaacattactgaattctagacttgaaaatctgtttaaatttatttttatagcaatggtaactgtactggtctggtagctgtgccaattctaagtataatatgctttaattaatgtatgctttggtgtttctgttaatggacactgatttttttttttttttttttaagacagagtctcactctgttgcccaggctggagtgcagtggcgcaatcttggcccactgcaagctccacctcctgggttcatgccattctcctgcctcagcctcccgagtagctgggaccacaggtgcccgccagcacgcctagctaattttttgtatttttagtagagacggggtttcaccatgttagccaggatgattttgatctcctgaccttgtgatccgcccactttggcccaaagtgctgggattacaggcgtgagccaccgcgcccggcctggacactgattttattcatgataaataaaatctaagcaagacatcctaatttagttccagtaaaatagtctgaaaagagtgctttttaatttttaaaatctagccaattaaggatgagagagtaaatctttactgagatagctcctctgacgctgagatgactggcctgcgtgctcttggtgctaacaaaattacattgttgaatgactgaatagcttcatcatgaaaaactttgctctctaaattgaatgttggctaactatgacatgtggaccaaatcctgccgttttttgtgaagttttattggaacacagccatgttaatttatttacatattgtttatggctgccttgatgctacaatggtaatgttgagtagttaccatagagatcatatgatcctcaacgtctgaaatatttactgttagccctttaagaataagtgtgctctgtatctaagtttttggagttagatcgtgttaaagttctgttggaggtttatgaggttagcattttcatgtttaatttcccattctacttcattttaagaaagaatactttaaatggtcattttgagtgtaagtttctggctttctcattcatgagtatggataataccaccttgcagtgttgctgtgaggataagtgaaaaaatgtaaataaaatgcttagctaactgcccagtacccagaaggaattcaaaaaatggggagatgcaatcagggaaagtgttggtgtctgggtaatttaagatggtatgtttttataggttctgatttgtccatagggctggcagtggaggcctagtttatccggcatctttatataactttgctgtctaatgtccctttatcctgttcttcctccgtccttaatccctttgctcctctctctctttcctctctttctcttttcctcctgatctttatattttcctccctttgtttcctttttgatatatgcaagcattggtactaaatttaggtcagtctcttagagtacgtagagagcctaatatgtagaatattgtcagttagtgttatttctattctctaggaagcagaagaattcgaaaatcttgtaatttccccctcctccttaatttttacataacgtttattggagccatctaggcatatgtaaaatctactcttaccgtagcaaatgttaggagagatcttcagtttttttggaacattatgccaagagttcatctttaggcaagcttggtattcttctagaagcaggatagatgatagatctttcctagcattttgaaggaaacttgaaaatctagtgatgataaaattgaccctagcaatcttatattagttagaacacttagttatgttcttgtttcatggaaacataaacttaaaaagctgttattttacttgacaggtaatgttagaagatcaatttgaaacttaggacctaacccccttcatgttattgtaaaaccagcattgatataaataagagaacaaggaaagagaattttaaaatagcttttgtttttattggtatttattattatttggcagtagtttttagtttttgtaggtgtcataaaaatacagaaaagagataaaattctaggatgatagttatagcattagcagaactttatgcaatagaagttaacaattagccatatttctagatttaggtcccctcatttgaaaatcttgttatccatagtaaatttaattgttttaatttagctaaattcttctgtttgtggtttaaaaaatagttaaattggtcaaatttctcattgactgttcctcccttcttaaatctgatacctaaatgcattaagcttaaattttatataccaccattctatgaaaaatcaagtatccttcctatttttctcatttattttacataaagctgagattttcatagaggcagatattaatcccgttttttcctctgaggacactgagtcatacagatatatatatgtatatttaaactgcagttttagtcagtataaagttggaaacacaaatgttagatttaccttattttgtatgttcataggaaccagataacaaaatttaaaaagtttttttttgtctagaaataggtaggtaacatcgaagatgagtgattgcttcagtttttcaaaaaattttgtcgaggggttacgagttttattctgtaggatatgaagagagtagtaggaaagttgtaagacttgatgaaacaactctaagacatatcgtgttagggttctgtttacttgtagatgagcaaaaccagtaacagattgatttcatctatcaaaggagaaagaagagaggggaagaagaaaaaaaagagacatattttttaatagcggattttgttttcctttccttggctaagctgctgattaattgacagccagcgaagagcccagacagggtatcctgtccttcagcagctggatgcatcatcaaagaaaacagttttagttgtttctgaatcctctagaagacgttttgtatttaattgtgacttgcatataagaggttgtctctgtgttaggtgtgccagtatccttgttagtgcttccatctcatttatgccagatctacatcagagtttctcacttgctttattatggccctgtttccatgatctttttttattttgtcttctttggtgtgttagacaagctttccaaaagttaatgttgtgtctttctggggttttgcttgccatcacaaatcattattttaaaattgtttacatgtaatttgttctcaaactcatgttcagatcaaaaaggtcttagtctgcttgagactatatgagagacctgaactacaatatgtaaagcatataggatggatttctctatcagttgtctagacgatattagtaaatcgtaaaaagtattgaccctaagcaatttatgctcttttacttaactgttgctttggaagtttaggttatgatttgtaatattttgccaattttattttctgtactcagattactgttgctatatgcttcacctttgagaagagtgggaacaatcttatggtaaagtgtttttgttttgttttatatttttatttatttttttacagtccaaggccattggtttgctagatgtggatgtgtatggaccttcagttccaaagatgatgaatctgaaaggaaatccggaattatcacagagtaagtaaagaagggataaatattataataatagttgcacttttattaatacttactgggtgtcagacattatgctagatgcaatgtatattttatgcacaatgtagtgtaagtcctcacttaagttagtagattcttggaaactgttactttaagtgaatagatatgttaattgatataaacaagagttaagttcctatggcatatttctggtcacaaaaacttcaccaaacttctaaataaagactcaaaacacttctaatattaaacaaagaaataaatttgggctataagtacatttaagaaagattaataaaaacaatataattatttacacaatttttagtgaatcagtgagtgaaagcagtcatagtggtggtgggttaaatcaaggaataggtgtttgcaaagtgaaaattgtaaggagcatctcttaccatcatgcaattcaagagtaaccaatatggcagatcattgagcattttcttactgcattgtttattgtgcatttgtatgattatcatatactttactagttttttttctttttttttttttttgagacagagtcccaccctgctgcccaggctggaatgcagtggtgtgatctcggctcactgcaacctctgcctcctgggttcaagtgattctcctgcctcagcctcccaagtagctgggactacaggtgcacgccaccacgcccagctaatttttgtatttttagtacagatggggtttcgccatgttggtcaggctagtcttgaactcctgacctcaggtgatccacccacctcaccctcaaaaaatgctgggattacaggtgtgagccactacacctggcccactaatttttatttggcaatcatttgtatccattcattcatcttccaacccacttattctggttcagggttgggggtgcctggagctatcctggcagctcagggcacaaggcaggaatcaaccctggaaaggaggccattccattgcagggtacactcacacacccacactcattcagactgggaccatacagacacgccagttcatctaatgtgcatagctttgggatgtggaaggaaactagagtacccgaatacccacgcagacctggggagaacatgcaaactttacacaagactgtggtcgtggcttgaaattgatttttttctttattaatgttacaacaaaatgatgttgaaagaaagcaattttattggaggacctgctgtatagtgattcagaaagcagacatgatagattccggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatttggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtaaccttgcagtatagtttgaagtcaggtagcgtgatgcctccagctttgttcttttggctcaggattgacttggtgatgcaggctcttttttggttccatatgaactttaaagtagttttttccaattctgtgaagaaagtcattggtagcttgatggggatggcattgaatctataaattccctttgggaagtatggccattttcatgatattgattcttcctacccatgagcacggaatgttcttccatttgtttgtatcctcttttatttcactgagcagtggtttgcagttctccttgaagaggtccttcacatcccttgtaagttggattcctaggtattttattctccagaatctacaatgaactcaaacaaatttacaagaaaaaaaacaaacaaccccatcaaaaagtgggcgaaggacatgaacagacacttctcaaaagaagacatttatgcagccaaaaaaacacatgaaaactgctcaccatcactggccatcagagaaatgcaaatcaaaaccacaatgagataccatctcacaccaattagaatggcagtcattaaaaagtcaggaaacaacaggtgctggagaggatgtggagaaataggaacactttgacactgttggtgggactgtaaactagttcaaccattgtggaagtcagtgtggcgattcctcagggatctagaactagaaataccatttgacccagccatcccattactgggtatatacccaaaggactataaatcatgctgctataaagacacgtgcacacgtatgtttactgtggccctaatcacaatagcaaagacttggaaccaacccagatgtccaacaatgatagactggattaagaaaatgtggcacatatacaccatggaatactatgcagccataaaaaatgatgagttcatgttctttgtagggacatggatgaaactggaaatcatcattctcagtaaactatcgcaaggacaaaaaaccaaacactgcatgttctcactcataggtgggaattgaacaatgagaacacatggacacaggaaggggaagatcacactctggggactgttgtggggtgggaggaggggggagggatagcattgggagatatacctaatgctaaatgacaagtcaatgggtgcagcacaccagcatggcacatgtatacatatgtaactaacctgcacattgtgcacatgtaccctaaaacttaaagtataataatagaaaaaaaaaagaaaaaaaaagcagacatggaagactgtactttgaggaatcatttctataattcgctactacagaagtttctctgaacacgtagagcaccgaattttaataaaataaataaaaagtatatatataaaaagaaatcagacatggtactggactgcctgggtttgattctcagccccatccatttactagctatatgacttgagtaaattgttttaatctttttgtgcctcagacccccatatgtaaaatagttacaactactgtgaggattaatataatgcatttagcagaatttctggcacatagtaagtgatcaaaaatggtagatcctcattattgtctctttatattaaatgtgtggatatatgggattatttgaataggaaatatatttgtgttcagaaaagatgaaaattattttctctgatcagatttcttggtcagatttgttttaaagtgttaaaaaaaactcccaaaacattattttctttccctagcctctttactagaaagaagtaatttttaaatacctctttaatgtttactgctgttgttattgcatttaaaaaataaagctatcagaagctttaagaagaaggaaatgttattatcaaaaaatgaattggcttggcttagtggctcacatggctgtaatcccagcactttgggagactgaggtgggaggacagcttgagcccaggagttcaagaccagcctgggcaacatagtgagacaaaaataaaaaaattagctgggcatggtggctcacacctgtagtccctgatattcaggggactgtggtaagaggatcacttgagtcctggaagtcaaggctgcagtgagccatgactgcaccactgtactccagcctggatgacaaagcaagatcctgtctgaaaaaaaaaaaaaaaaaagaaaaagaaaagaaaagaaaaaaaggaattggaaaaactgataatttttttaaaagaatggttttatgggaaattggtttattgatttgtaatgataatgagtataaaattgaataatttctttttgttcttattgggctttttattttccattgttctagagaaaatgactatatttactcctgtatatttattggattatctctgtaggtaatagaagattatttttgttgtcattaaaagttaattcagcattgcttaccatttaagaggcttttgtttgtggtttagttgttggagccaattataatgttaagttttggataattctttatgagacagtaaagattctccctaacattttgaagaaaacttaaagattttagtgatgttaacattgaccctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaaaaaaaaaaaaaaaacactttctctgttgacaggctgatcttaagtcccccaagaaataaactgaatgattaaggcgttcacttaaaagaatgtggaatcttaaaaatgcaacttataaattatttttgaatcttagaaaaacctgccaccattctactaattggtatcattctgacatttctacatttttcatgttaatttatcctattctgctattacagaaaacacaatacaatacaaaattacctaattaacaataaagagaaactatgaaaggcttgtttccagcagttcaggttttggggagatagaccagtgaattgaatcccacctttataggtgttcctctgttctgggactaagctggacagccttgcaagcagtgggacttcagaattacctttctccttattatttaaatagatgtatggcaatgtagtttttgacaatttgttcattttaaaatgatatgttagggttggcagatcatacgtttatccacattctcttcatacctttttttgggagggtggggggaattgtagaaaaacaacacattttgcatttaagacattttagccttcattaccaagagaaagtttctgttcgattttaaaaaagtgaattcagtaattgaagattttaagtttataatagttttgagtttcttaggctgagaatgtttccgtcagcttaaaatgacaatagtgatttttctatgttatcatgcaaaattatggtagtggaaaatctagccagtttgtagaaagggcattatgcaaaagcatcaacaggctgacattataatgactgaagatgagcagttactttgggaagctagtgggatttagaataaaacctaaacgtccttggagaaaccagcatctaagcatgaatataaccttttttaaagaacaaatgccaattttttccttcattttagctttccaaatagtgtcaaattcagatttcatattatagtatagccaaattatagtcctagaaattattgtaggttttcaattgaaatggcaaatgaatattaaatggctgttgcacaagagagacaacacatctctctcttagtagatattagtagaaatatctgctttgtttcatagttttgtgatgaaaaatcactttcagaatactggtgaatttattactacttagttttactgaagagtctttaaatgtaatgagctaataaagtaggaaaatttcaagacctgtggagagagtttactaaaatggatatgtcaagtattttattgaggatgacacagtgtttattagtgattttgagtaggatccccttgtcttttctattgtgggatagtaattttgcactcatggcacagttttctgctctatttgtttaaagttagtaaacttttttcaagtttaggaattaatgtgtatgtaggcttctgagacagagaagtggaaaatcagcttgagcaaatgaccttttataatctctgataaaaactacaaagaagggactgagatcttctgcttctttcttctttcttcttctttcttctttcttcttcttcttcttccttccttcctccttctccttctccttcttcttcttcttttccttcctcctcctcctcttcctcctcccttctcctttctcgtctcctcctttcttcctcctcccttctccttccttgtctcctcccttcttcctcctccttgtctcctcccttctccttccttctctcctcctcccttctccctcctcctcttgtcctctcttctccctcctcctcttctcccctctccctcctcctctcgtcctcccttctccttcttccttttctcctccctcactccttctccctcctcctccctcctcctccattcttcttcttcttcctccttcatcttcctttttcttttcttttcttttttttttttttttgagagtatcactctgttgcccaggctggagtaaagtggtgccatcataactcactgcagcctcaaactcctgggctcaagtgactgtccctcctcagcctcccaagtagctgggactacaggcgtgtgccaccatactggctaatttttaattttttgtagagctggggtctcactgtgttgcccaggctggtcttgaactcctggactcaagcaatcctcctgctttggccacccaaagtgctgcgattacagggctgagccaccacacctggcctggaactgagatttcttaaaggtaacttaagtgcttaaagaatgagagtgaactctagttattccttaagtcactctgttgtttccttccagagaagagatctaggggtgttgctgaaggtgttaacatgcaagatcacattcctatccaaagcatggagttcccaaagggtgtaacagctatttgctgctcggcttgtggatgttagcccagccggttagggtggttctggggatactcaccagatacctccagttttaagatgactagtacagtagcctcatgggccacagagggcagggcatattgttggctcctctttggggtatcatagatatgtggactgcaggaggctccttcagcttgaggtctgtagttgtccaaggttttgatgggggttgttggaatattcttgcttacctcttcactgtagggaaaatttcctcctgattcccagctgatcctggttgctgggatagggttgtggagttggtgtatccaaatgtagttatttatttgttgttctggctgtctttgtgaggaggatgagcaccaggggcttagtcaactctcttgctgacatcactttattttgttctttaaaggggcaatcattacagaactggaagaaaagagaatagtgatgtttcattgggaaacttggctattaaccttctctaattttcagtttagaaacttaactagctggctgggcacagtggctcacgactgtaatcctagcacttcgtgaggccgaggcgggcagattgcctgagctcaggagttcaagaccagcctgggcaacatggtgaaaccccatctctactaaaatacaaaaaaatttggctgggcgtggtggtgtatgcctgtagtcccagctactcgggaggctgaggcaggaaaattgcttgaacctgggaggtggaggttgcagtgagccgagatcgtgccactgcactgcagcctgggtgacagagtgagactttgtctcaaaaaaaaaaacaacaaaaaaacaccagggaccagtcccggtatgtgacctttcagacaaagaattcaaaatagctgtgtgaggaaactcaaagaaagtcaagatactacatagaaagaattcagaattctatcagataaatttaacaaagagattgaaataattaaaaagattcaagctgaaattcttgagctgaaaaatgaagttggcatgctgaagaatgcatcagtcttttaatagaattgatcaagcagaagaaagaattagtgaacttgaagacagactatttgaaaatatatagtcagaggagacaaaagaaaaaagaatgaaaaacagtgaagcacaacaacaggatctaggaaatagtctcaaaagggtaaatctaagggttattggccttaaagaagagggaaaagaaagagctagaggtagaaagttcattcaaaggataataacagatcacttccaaaacctggagaaagatatcaatatccaaaagtacaataaggttataaaacaaaacagatttaaccaaaagaaaactatccaaaggcatttaataatcaaactcccaaagatcaaggataaagaaacaatcctaaaagcagcaagagaaaagaaataaatgacatacaatggagctccagtacctctggcagcagacttttcagtggaaaccttacaggccaagagagaatggcatgacatatttaaaatgctgagggaaaacacttttaccctaaaatagtatatctggtgaaaatatccttcaagcatcaagaagaaataaagactttcccagacaaacaaaagctgagggatttttaacaccagacttgagctacaggagatgttaaagggaatacttcatcagaaagaaaaggacataggctgagtgtagtggctcactcctataatcccagcactttgggaggctgaggcgggcggatcacctgaggtcaggagttcgaggccagcctggccagcatggtgaaaccctgtctctactaaacatacaaaaattagctgggcatggtggcgggcgcctgtagtcccagctactttggaggctgaggcaggagactcacttgaacccaggaggcagaggttgcagtgagccgagatcatgccactgcactccagcctgggtgacagagtgagactgtctcaaaaaaaaagaaacaaagaaagataaataaagaaaaagacattgatgaacagtaggtaatcacctgaaggtacaaaactcactcgtaatagtaagtatgcagggaaaaaaagatttttgtaacattgtaactatgtgtgtaatctactcttatcctaagtagaaatctagacttagaatctaatgctgccactgatctgacaggaggcggaactcagacagtaatgttcccttgcctgctactcacctcctgctgtgtggcccagtttctaacaggccacagactggtactggtttgcggcctgggggttggggacccctgggttatcagatagaattgcaagcctcatggtaacctcaaaccaaaaaacattcaatgaatacacaacaaataaaaagcaagaaagtaaattatatcaccagagaaaatcagcttcacttaaggaagacaggaaggaaagaaggaaggaagagaagaccacaaaacaaccagaaaacaagtaacaatatggcaggaataagtctttatttattagtaataacaatggactaaactctccaatcaaaagatggagtggctaaatagataaaaaaaaacaagacccattgatttgtagcctacaagaactacatttcacctataaagacacacatagactgaaaataaaggggtataaaagatactccatgccaacagaaaccaaaaaagagcaggagttgctatacttacatcagacaaaacagattttaagacaaaaatctataagaagagacaaagaaggtcactatataatgataaaggggtcaatgcagcaagaggatataacaattttaaatatatatgcacccaacactggagcacctggatatataaagcaaatattatcagagctaaagaaagagataaagctcaatacaataatacctggagacttcaataccccacttgcagcattgaacaaatcttccagacagaaaatcaacaaagaaacatcagactttatctgtatagacataagggatctaatagatatttacagagcatttcatccagtgaatgcagaatacacattcttttcctcagcacatggatcattcttaaggatataccacatgttaggtcacaaaacaagtcttaaaacattcaaaaaatggaaataatatcaagcatcttctctgaccacaatggaataaaattggaaatccataacaagaattttggaaactgtacaaatacatggaaattaaacaatatgctcctgaatgacctgtgggccaatgaagaaattaagaaggaaattgaaaaatttcttgaaaaaaatgataatggagatataacataccaaaccctgtgggatacaacaaaagctgtactaagagggaagtttgtagctataagtgcctatatcaaaaagaggtaaaattttcaataaacaatttaacgatgcatcttaaagaactagaaaagcaagagcaaactacacccgaaattagtagaagaaaagacataataaagatcagagaagaagtaaatgaaatgaagaaaacaatacaaaagatcaatgaaacaaaaagttgctttttaaaaagattgacagaattgacaaacctctagccagactaagaaaagaggaaagaagattaaaaataaacaaaatcagaaatgaaaaaggagatgttacaactgatactgcagaaattcaaaggatcattagtggctactgtgagtaagtacatgccaataaattggaaaatctagaagaaatggataaattcatatacacgtacaacctaccaagattgaattaggaagaattcaatcttcctaaacttaaacagaccaacaacaagtaacaagatcaatgctgtaataaaaagtctcccagtaaagaaaagtccacgacccaatagcttcactgctgaattctaccaaatatttaaagaaccaataccaatcctactcaaactgttctgaaaaacagaggaggagggaatattgccacactcattctgtgaggccagtattaccctgatatcaaaaccagagaaagatacatcaaaaaaaaaaaaaaaaaaaaaagaaagaaaactgcaggccaccttctctgatgaatactgatgcataaatcctcaataaaatactaggaaaccaaattcagtaatacattagaccattcatcatgaccaactgggatttatccctgggatgcaaggatggttcagcacaagcaaatcaattaatgtgatgcagtgtatcaacagaatgaaggactgaaaccatatgatcatttcacttgatggtgaaaaagcatttgataaaattcaacatcccttcaggatacaaaccttcaaaaaactgggtatagaaggaacatacctcaacataataaacagcatgtatgacagaccctcagctagcatcataatgaatggagaaaaactgaaagccttccctctaatatctggaacatgacaaggatgcccacgttcaccactgttattcaacatagtactggaagtcatagctagagcaatcagacaagagaatgaaataagggacatccaaattggaagggaagatgtcaaattattcttgtttgcagatgctttaatgttatatttggaaaaacctaaagactccacaaaaaaactattagaactgataaacaagttcagtaaagctgcaggatacaaaatctacttgcagaaattggtagcatttttatatgccaacagtgaacaatcttagaaagaaaaacataatcccgtttataatagccacacataaaattaaatacttaggaattaaccaaaaaagcaaaatatgtctataatgaaaactgtaaaacactgatgcaaataactgaatgggacacacaaaaaatggaaagattttccatgttcatggattggaagaatcaatattgttaaattgtccctactattcaaagcaatctacagattcaatgcaatccctatcaaaataccaatatcattcttcatggaaatagaaaaacaattctactatttatatggaaccacagaagatccagaatagccaaagctaatctaggcaaaaagaacaaaactggagggatcacattacctgacttcaaattatgctacagagctgtagtaaccaaaacaggatggtactggcataaaaacagacacacagacgaatagaaccaaataaagaacccagaaacaaatatacacacctgcagtgaattcattttcgacaaagtttccaagagcatacagtgggggaaaagatggtctctttaataaattgttttgggaaaactggatatttgtatgcaaaagaatgaaactagacccctatctctcaccatatgcaaaaatcaaataaaaatggatgaaaaactttgagaccttcaactgtgaagctactaaaagaaaacattgggaaagatctccaggacattggcttcaacaaacatttcttgagcaatacccaacaagcacaggcaaccaaagcaaaaatgggcaaatggtatagcatcaagttaaaaagctgctgcagagcaaaggaaacaatcaacaaagtaaagaacaacccacagaatgagagaaaatatttgcaaactacacatctgacaagacattaataatgaatatattactttgtacattaattttaatggcaaaaactgcaattacttttgcaccaacctgatataaggagctcagacaaatctataggaaaacaatctaataatctgataaaaaatggacaacagatttgaataggcatttctcaaaagaagacatgcaaatagcaaacaggcatatgaaaaggtgctcaacaggctgggcgcagtggctcacgcctgtaatcccagcacttgggaggccaaggcgggcggatcatgaggtcaagagatagagaccatctggccaacatggtgaaaccccatctctactaaaaatacaaaaattagctgggcgtggtggcatgtgcctgtaatcccagctacttaggaggctgaggcaggagaattgctcgaacccaggaggcggaggttgcagtgagccaagatcgtgccactgcactccagcctggcaacagagcaagactctgtctcagaaaaaaaaaagaaaagaaaagaaaagaaaaaaaaaggtgctcaacattactgatcatcagagaaatgcaaatcaaaactccagtgagatatcatctccctttagttaaaatggcttatatccaaaaggcagaaaataacaaatgcaaggatgtggaggaaagggaacccttgtatactgttggtgtacatagtggttgaaccactatggagaacaatttggaagttcctcaaaaaaacaaaaaatagagctaccatatgacccagcaatcccactgttgggtatatacccaaaaggaaggaaatcagtatattgaagagatacctacactcccatgtttgttgcagcactgttcacaatagctaagatttgaaggcaacctaagtgtccatcaacagatgaatggatacagaaaatgtggtacgtatacacaatgggtactagtcagccataaaaaggaacgagatcctgttatttgcaacaacatggatggaactggagatcattatgttaaatgaaataagccaggcacagaaggataaacattgcatattctcacctctttgtgggatctaaaaatcaaaacaattgaactcatggacagagagagtagaaggatcgttaccagaggctgggaagggtagtaggggagttgaggggatgtggggatggttaatggatacaaaaagatggttaggaagaatgaatagatgaactatttgatagcacagcaaggtaactgtagtccgtaataacttattgtacatttaaaaataactaagagagtgtaattggatttttttttttttgaggtggagtctcgctccttagcccaggctggagtgcagtggtgcgatctcaggtcacagcaacctctgcctcccaggttcccgttcaagcaattcttctgtttcagcctcctaagtagccgggattataggcacgcaccaccatgcccagctaatttttgtatttttagtagagatggggtttcaccatgttggccaggctggtcttgaactcctgaccttgtgatcctcctgcctcagcctcccaaagtgctgggattacaggtgtgagccactgcgcccggcctaattggattgtttacaacacaaaggataaatgcttgagaggatggtaccctatctccatgttgtgattattacacattgtatgcctatatcaaaacgtctcatgtaccccataaatatatacatactatgtactcacaaaaattaaaaataaaaaattaaaaaagaagtcttcaataagagatatatatatatatagaaaataaaatggcttgtgtatgtttgtattcattttattgcatctatttgataatttttgatttttaaaatataaaatttggtagtatcaaagtccagaactgaaacgttgacttctttatggatggggcttatgggggatatgtaatgctggtcagttttaaatacagtagtattgtggggattagaaccctaatataggggctaagttttaactgataatcatttggttcttctgtaagcaagtttttttgtttcaaacaaataaatgattgtataatacatttaacacagaagcctcacaatagcaggattattcttactgtcagattacaactactattgttgggcaagaatagcaactaaaaattgagataccagttttaataatcagaaagtactgagtttagacagctctctttgaatatattagtaagtagcatagcctttggaggaacatttagggcttttttcttataaatgtttatcacagtgggtgaaaaaggttatacacacatacacacacatacacagacacacatacatgtgtatatttaagtagaacatatttttaatttttttacatgcaacttaactagcactggcttgaaaacttatgattttcttaaaaaattatgaaatttgctcttaaaaacttatgattattttaaacctagtgttaaaattttcagttgggtcaaaagtgatacattaaaggagacattatttctgtttatttagtagacctttatgactgtcttttgtgtagttagtcggcatgagaaatacttggttatatggttatcaaatcagatttggtctttctctgtgaacttacagtagacatactagccattgattataagcatcagtacatgctgtaatagaaatataagtgtttttgtgtgtgtgtaaacctagagatggtaactaaatgaaactggagctttgagattttttggaagagatgattcttgggctaaactttgcaaagtagataagccaggagtctgttgtaagaaggtattgaggattgacaatgaggatggtgatatagtttggctctgtatccccaccccaatgtcatgttgaattgtaatcctcatgtgttgaggaatggacctggtgggaggtgactggatcatgggggtggtttctcccatgctgttctcatgatagtgagtgagttctcattagatctgagggttttaaaagtatggcacttcccctctctctctctcctgccaccaagtaagacgtgccttgcttccactttgccttccaccatgattgtaagttttctgaggcatccccagccatgcagaactgtgagtcaattaaaccttttttattattattatacattaagttctggggtacatgtgcagaacgtgcaggtttgttacataggtatacacgtgccatggtggattgctgcacctatcaacccatcatctacattaggtatttctcctaatgctatccctaccctagcccccccaactcactgacaggccctagtgtgtgatgttcccctccctgtgtccatatgttctcattgttcaactcccacttatgagtgagaacatgtggtgtttggttttctattcctgtgttagtttgctgagaatgatgatttccagcttcatccatgttcctgcaaaggacatgaactcaccttctttatggctgcataatatttcatgatatatacatgccatattttctttatccagtccatcattgatgggcatttgggtgggttccaagtctttgctattgtgaacagtgctgcaataaacatacgtgtgcatgtgtctttatagtagaatgatctataatcctttgggtatatacccagtaatgggattgctgggtcaaatgctatttctggttctagatccttgaggaatcaccacactgtcttccacaatggttgaactaatttacactcctagcaacagtgtaaaagcgttcctatttctccacatcctctccagcatctcgtttcttgacttttaaatgatcgccattctaactggcgtgagatgatatctcattgtggttttgatttgcttttctctaatgaccagtgatgatgagatttttttcatatgtttgttggccacatgaatgtcttcttttgagaagtgtctcttcatatcctttgcccactttttgatggggttgtttttttctttttgtttaagttcttttagattctgcatattagccctttgtcagatggatagattgcaaaaattttctcccattctgtaggttgcctgttcactctgatgatagcttcttttgctgtgcagaagctctttagtttaattagatgccatttatcaattttggcttttggtgttttagtcatgaagtctttgcccatgcctatgtcctgaatggtattgcctaggttttcttctagggttttatggttttaggtcttacgtttaagtctttaatccatcttgagttaatttttgtgtaaggtgtaatgaagggatccagtttcagctttctgcatatggctagccagtttttttttaacactgtttattaaatagggaatcctttccccattgcttgtttttgtcaggtttgtcaaagatcagatggttgtagatgtgtggcgttatttctcaagcctctgttttgttccagtggtgtatatatctgttttggtagcagtaccaagctgttttggtaactgtagacttgtagtatagtttgaagtcagcttgcatgacgcctccagctttgttctttttgcttaggattgtcttgtctatatgggctctttttttgttccatatgaaatgtaaagtaggttttttctaattctttgaagaaagtcaatggtagctggatgggaatagcattcaatctataaattactttgggtagtatggccattttcacaatattgagtcttcctatccatgagcatggaatttttttttccatttgtttgtgtcctctcattttcttgagcagtggtttgtagttctccttgaagaggtccttcatgtcccttgtaagttgtattcctaggtattttatgttctttgtagcaattgtgaatgggagctcactcatgatttggctctctgtttgtctgttattggagtataggaatgcttgtgatttttgcacattggttttgtatcctgagactttgctgaagttgcttaccagcttaaggagattttgggctgagatgatggggctttctaaatatacaatcatgtcatctgcaaacagggacagtttgacttcctctcttcctaattgaataccctttatgtttctttctcttgccttattgccctggccagaacttccagtactatgtggaataggagtggtgaaagagagcatccttgtcttgtgtcagttttcaaagggaatgcttccagtttttgcccattcagtatgatattggctgtgggtttgtcataaatagctcttattattttgagatatgttccatcaatacctagtttattgagagtttttagcaggaaggggtgttgaattttgttgaaggccttttctgcatctattgagataatcgtgtggtttttgtcattggttctgtttatgtgttggatcacgtttattgatttgcatatgttgaaccagccttgcatctcagggatgaagctgacttgatcttggtagataagtgttttgatgtgctgctggattcagtttgccagtattttactgaggaatttcacatcgatgttcatcggggatataggcttgaaattttctttttttattgtgtctctgccaggttttggtatcaggctgatgctggcctcataaaatgaattagggaggagtccctctttttctattgattggaatagtttcagaaggaatggtaccagctcctctttgtacctctggtagaattaggctgtgaatccatctgggtctggacttttttttgttggtaggctattaattactgcctcaatttcagaacttgtttttggtctattcagggatttgacttcttcctggtttagtcttgggaaggtgtatgtccaggaatttatccatttcttctagattttctagtttatttccgtagaggtgtttatagtattctctcatggtagtttgtatttctgtgggatcagtggtgatatttcctttatcttttttaattgcatctatttgattcttctctcttttcttctttattagtctggctagcagtctatctagtttgttaatcttttcaaaataccagctcctggattcattgattttttgaagggtgttttgtgtctctatgtccttcagttctgctctgatcttagttatttgttgtgttctgctggcttttgaattggtttgctcttgcttctctagttcttttaattgtgatgttagggtgtcaattttagatctttcctgctttctcttttgggcatttagtgccataaatttccctctacacactgctttaaatgtgtcccagagattctggtatgttgtctctttgttctcattggtttcaaataacaaacttctttatttctgccttcatttcattatttacccagtagtcattcaggagcaggttgttcagtttccatgtagttgtgcagttttgagtttcttaatcctgaattctaatttgattgcactgtggttgcagaacctgtttgttatgatttctgttcttttgcatttgttgaggagtgttttacttcaaattatgtgatcaattttagaagcagtgtgatgtggttctgagaagaatgtatattctgttgagttagggtggagagttctgtagatgtctattaggtctgcttggtcctaacttgaactcagagctgagttcaagtcctggaaatccttgtgaattttctgtctcgtagatctgtctaatattgacagtggggtgttaaagtgtcccactattattgtgtgggagtccaagtctctttgtatgtctctaagaacttgctttacgaatctgggtgctcctgtattgggtgcatatatagttaggatagttagctcttcttgttgcattgatgacttcatcattatgtaatgtccttgtttcttttgatctttgttggtttaaagtctgttttatcagagactaggatcgcaacccatgctatttttttgctttccatttgcttggtaaatattcctccctccctttattttgagcctatgtgtgtctttgcatgtgagatgggtctcctgaatacagcacaccaatgggtcttgactctttatccaatttgtcagtctgtgtgttttaattgggacatttagcccatttacatttaaggttaatattgttatgtgtgaatttgatcctgtcattaggatgctaggtggttattttgcccattagttgatgcagtttcttcatagtgtcgatggcctttacaatttggcatgtttttacagtggctgttaccagtgattcctttccacgttttgtgcttccttcagaagcttttgtaaggcaggcctggtggtgacaaaatttctcaatatttgcctatttgtaaaggattttatttctgctttgcttatgaatgtagtttggttggatatgaaattctgggttgaaaattcttttctttatgaatgttgaacattggcctccactttcttctggcttgtagggtttctgctgagagatccgctgttagtctgattggcttccctttgtgggtaacccggcctttctctctggctgcccttagcattgtttcctttatttcaaccttggtgaatcctacgattatgtgccttagggttgctcttttcgaggagtgtgtttttggtgttttttgtatttcctgaatttgaatgttggcctgccttgctcggttgggggagttctcctggaaaacactgaagagtgttttccaacttggttccattttccctgtcatgttcaagtacgccaatcacatgtagatttggcctatttacatagtcccatatttctgggaggctttgtttgcttcttttaactcttttttcactaatcttctcttcttgctttatttcattgagttgatcttcaatctgtgatatcctttcttctgcttgatcaattcagctattgatacttgtatatgcttgatgaagttcttgtgctgtgtttttcagctccatcatgtcatttatgttctttaaaccagttattttagttagcaattcatctgacgttttttcaaggttcttagcttcctgccattgggttagaacatactcctgtagctcagaggagtttgttatccaccttctgaagcctactactgtcaatttgtcaaactcattctctgtctagttttgttcccttgcttgcaaggagttgtgatcctttggaggagaagaggcattctggtttttggaattttcagcctttttgtactggtttctccccatctttgtggatttatctaccttttgtcttttatgttagtgtcctttgcatgggttctctgagtggttgtcctttttgttgatgttgatactattcctttctgtttgttactttatcttctaacagtcaggcccctgtgctgcaggtctgctggagtttgctggaggtccacaccagatcctgtttgcctgggtatcaccagtagaggctgcagagcagcaaagattcctgcatgtttcttcctgtggaagcttcatcccagagaggcacccaccagacgccagccagagctgtcctgtatgaggtgtctgttggcccctactgggaggtgtctcccagtcaggatacacaggggtcagggacccccttgagtaggcagtctgcaccttatcagagctcgaacactgtgctgggagatctgctgctctcttcagagctgttaggcagggatgtttaagtctggtgaagctgcgcccacagccgcaccttcccccaggggctctgtcccagggagatgggggttttatctataagtccctgactggggctgctgcctttctttcagagatgccctgcccagagaggaggaatctagaggggcagtatggccgcaccagcattgctgagctgcggtgggctccacccacttcaaacttcctggcggctttgtttacactgtgagggtaaaaccgcctactcagggctcagcaatggcagatgctcctccccctacgaaggtcgagcgtcccaggttgacctcagactgctgtgctggcatgagaatttcaagccagtggatcttagcttgctgggctccgtggggtgggacttgccgagccagaccacttggcttcctggcttcagccccctttccaggggagtgaacggttttttttctcactggcgttccaggtgccactgaggtatgaaaaataaactgctccaggtagctcggtgtctgcctaagtggcctcccagttttgtgcttgaaacccagggccctggtggcatacataggtgccagagggagtctcatggtctgccagttgcgaagaccgtgggaaatgtgcagtatttgggctggagtgcacagttcctcttggtacagtctctcaccacttcccttggctgggggagggaaatcccttgatcccttgtgcttcccaggtgaggtgatgccccaccctgctttggctcaccctccatgggccgtacccactgtccaaccagtcccaatgaaatgaactgggtacctcagttggaaatgcagaaatcacccgccttctgcgtcgatctcgctgggagctgcagactggagctgttcttattcagccgtcttgccagcaaatcctaaacgtcttttttaaaataaagtacccagtcttaggtagttctttatagacgtgtgaaaatggactaatacaggaaattggtaccggtagagtggggtactcctctaaagataaccttaaaatgtggaggtgaggttggaactgggtaacatgcagaggttggaatagtttggagggctcagaagaagataggaagatatgggaaagtttagaacttcctagtgtctggttgaatggttttgaccaagatgctgatagtgatatgcacaatgaagtttaggctgaggtggtcttagatggagatgaggaacttcttgggaattggagtaaaggtcactcttgctatgctttagcaaagagactggtggcattttgcccctgccctagagagttgtggaactttgaacttgagagtgatgatttaggatatctggcagaagaaatctctaagcagcaaagcattcaagatgtgacctggccttttctgaaagcatacagtcatatgcatttacaaagagatggtctgaaatttgaacttagtttaaagggaagcagagcataaaagtttggaaatattgcagcctgaccatacggtaggaaagcaaaactcgtttttttggggggagaaattcaagctggctgcagaaatttgcgcaagtaatgaggagcgaaatgttcatcaccgagacaatggggagaatttctccagagaatttcagggatcttcatggcagcccctcccatcacgggcttaggagggaaaaatggttttatgatccaggcccaggactccactggtctttgcagccttgggacatggcaccctacatcccagacactctagctccagctgtggctaaaagacgccaaggtatggctcaggccattctttcagagggtgcacactccaaatcttggcagcttccacatgctgttgggcctgcaagtgctcagaagacaagagttcagctctgggaagctctgccttgatttcagaggatgtatggaaatgcctggatgtccaggcagaagtctgctgcaggggcagagcccccatggagaacttcttttagggcaatgcagagggggatatgttagattggagcccccacagagtccctactggggcacttcctagaggagctatgagaagagggctactgtccttcagaccccagaatggtagatccaccaacagcttgcaccgtgtgcttgggaaagccgtagtcactcaatgtcagttcatgaaagcagccacaggggctgtactctgcagagccacaggggtggagctgcccaactcctcgggagcccaccccttgcatcagcatgtcctggatgtgaaacatggagtcaaaggagtttattctggagctctaaaatttaatgactgccctactggattttggacttgcatggggcctgtagcccctttgttttggccaatttctcccatttagaatgggatcatttatgcaatgccagtacccccattgtatcttgcaagtagttaacttctttttgattttacagactcatatgtggaagggacttgccttggctcagatgagactttgaacttggacttctgagttaatgctggaatgagttaagactttgggggactgttaggaaggcatgattggttttgaaatatgagaaggacataagatttgggtggggctgggggaatgatattgtttggttcagtgtccccacccagatctcatgttgaattgtaatccccatgtgtcaagggcaggacctgatggaaggtgattggatcatgcgggatccccccatgataatgagtgagcccctgtctctttctttctttttttgctgccatgtaggacgtgctttgcttccacttaggcttctgctatgattgtaagtttcctgaggcctgtccagtcacacagaactatgagtcaattaaacctcttttctttattacccagtcttaggtagttctttatagtagtatgaaaacggactaatacgtatggcaatcaagggagggggaatagcaggtgttaaaagttgcacaatgtaagcttttgggcatggttaaagtaaaagtctttgaggttgagttgcaagagtgagagcagggccagaaaggtaattgagagtcctgtcataaataccctcttgggtttgtttgaagagttgaagtgtgtgattcagacactatgagatgctatcatggattttaggtaagggagtgacactcagttttgcattctgggaggaacattttgacagcattgtgaaggaaacgtaataggactagatgcgatgtaggggccagttgggatgttatgcagtgatccaggtgagatgtaataagtcctgatttaagtctgaagtgatagaaatggagaggaggagacctaattgtgaggtattaaagagaatggatgaatagaccttggtaatttattgagtatgactgagaaaaaggtctctgaatggcccttgattttctgagttggatgactatgtagatatattatccatcaggatagagcagataggaaaaaggaatacatttaagaaatgtattcttaaatgatgaattaggttatgatatgttgaatttggttgatgcctagacagaattagtcaacagatggttggatatgtgtttggaattaaggagagaggtttgggttaaagatacacatttgtgagttagcagtataggtaatattaaatagttggagttgttagttgagatcaatgaatctcaaccagaggtgattttgatgtgtagaagacatttagcaatgactaaagactttatttatttatttatttatttgagatggagtctcactctgttgcccaggctggagtgcagtgatgtaatctcggctcactgcaacctccgcctcctgagtttaagcaattcttctgcctcagcctcccgagtagcttggattacaggcgcctgccaccatgcccagctaatttttgtatttttagtagagacagagtttcatcatgttggccaggctggtcttgaactcctgacctcaagtgatccgcctgccttggcctcccaaagtgccgggattacaggtgtgagccaccgtgcctggccaactgaagacattattgattgtcaaatcttggggatgctactgacatcttataggtggaggccagagatgctgctaatatcctccaatgcacaagacactctcccacaacaaattattatccagtccaaaatggcagttgtgttcaggttgagaaaccatgattagacaacataacccaaaagagttttagagggagtcaagtataggattgagggtagaattttgggaaatattagcctaaggtcatcagagaaagggtatgaagaggtgatcagagaagtagaaagaagaccaggaaagaactgtaccctagaagccaaggaagcagggagttttgggaggaagtggttaacatttttagcatggctaaataggataataattgaaaattacattttagatttgacagtatgttcaaaatttcagtttatgaaactgttatgttgaagacatctgagcacaacttaacattgtgcttctcgaagcaacatactatgtgtgacccttaggaaatcaatcatttgggaatctattgagtatctctagcctagtacattgctatgctctagggataagaagtgggtaagatataaattctatttcttttctttctttttttttttttttgagagggagtcttgctcttgtcgcccaggctggagtgcaatggcatgatctctgctcactgcaacctctgcttcccaggctctagtgattctcctgcctcagcctcctgagtagctgggactacaggggcatgccaccacacctggctcacttttgtatttttagtagagacagggtttcaccatattggccaggctggtctcaaactcctgacttcaagtgatctgccagcctcagcctcccaaagtgctgaaattataggcataagccactgtgcccggctgctatgtctgaggggttcatagtccagtgggggagatgaaaaaatgtcaacacattaagtaccatagtaaatagtagggaatgaacagaagaccatggaaacagaggaacttccagtctttctatgatgtagtcctgtcaaccctgtaccccgataaggcttgcaatcaaagagcataaagagaaacaagagagttgggtatatttttaaaaaggtaatggaaagatcatgtttatctttttaattttgattaaaaaactgacagcaaaactgtgggccatatattccatctattatgaacaaaatatgtgtgggatattttatttataaatcaccttttattacctccacaccaaagtagccatttacctttatcttattttattttattttatttttttattttgttttttgctctgtcacccaggctggagtgcagtggtgtgatctctgctcactgcaaactctgcctcctgggttcaagcgatccccctgcctcagcctccttagtagtagtcccagcgcctggctaatttttgtatttttagtagagacgggttcaccatgttgatcaggctggtctcgaactcctgacctcaggtgatccgcctgccttgtcctcccaaagtgctgggattataggcatgagccaccgcacctggcccactgtttagctttagaatgtgcctcacagacatataatctctgtaaccttcctctttcctttttatctactgctgctgctttgtaattccaggcagagattggaaatggcagtaagtaacctagggttgtggcaatctgagagttgtttagagaatatgtaagatggtcctagagttggctttttctcttgccacttcttgccaaaacgagctacacctgtctaatatctaatcccaggtttgactcacaggtgaggagtgagacttctcaccagtttgtgttcttaaggttcctaatttagattataaatagagcataacaacataaaatgttagaaatggaaagtcctttggagagattaattcatatatgattattaccagggttgagtgatttgcttgtaatcatgtaatagttactgacagaattgaaagcccagaagggtgtcttcatgggaaccacatttcagggacattggttcccaaacatcatgaagggagtacatcagaatcatctacactgcttgttaaatatacagatttccaggcttaccgtagacccatggaataaaaaaaggtctgggaggagctattggtagttgttaccttattagtagataattcagagttatgaacaaagtactttaaactctatctagcacatggtaagcaccagtgcatattgttttcattagtattttatcagtattattgtacaatctgaaatgtgggaggaaaaaagggaattgaaatgatttttttcctttttaatttccccgctttactttttaaaaaaaaactttctcataagggaaaccttatgagaaaccaagaagtaattaaagttcacaagaaggcatgtagatgtcaagagtgttgtataatgatttttatttgctcaggaaaaattagaaagtgaaagtgtagaaatgcaatgcatttcggcttactctgctcatcttcagcttgtactgagtatttcattatagcataatatagtgcagtggttctaagactttttggtctctggagtctttcatgatgttaaaaattattggccgggcacggtggctcacgcctgtaatcccagcactttaggaggccgaggcgggcggatcacgaggtcaggagatcgagaccacagtgaaaccttgtctctactaacaatagaaaaaattagccagacgtggtggcgggcacctgtagtcccagccactcaggaggctgaggcaggagaatggcatgaacccgggaggcagagcttgcagtgagctgagatcgtgccactgcactccagcctgggtgacagagtgagactctgtctcaaaaaaaaaaaaaaaaaattattgaggatcccaaatagatttgttaatgtagattatatttatttatatttaccatattagaaattgaaacagaaatttaaaaagttattaattcattaaaattaggcccataaacttgttaatgtgaataacattttaatgaaaaataactattttctgaaaaaacagttgagaagagtggcattgtttatgtttttgtaaattattttaacatcttgcttaatagaagactgccagattctgtctacttttgcatttattctgttgtaaggtgttgttttggctgaagcatatgaagaaaatccagccccatacagacatgtagttgtaaaaaagaagaatattttaatagccttttaaataagtgtggattttctcctcttatactacaccaaaatttggcaagtgttggtttcttaaacatgagttagaatgtttaatttgagaccatatctgtgaagtttattcagtcttgtatattgtagactttgaagtggatcttatagccatgcatgattttataacatcatgtattgctcatttagaaaacattagttcattgatttatgctggtcttctaagtgtttacacatttcattatataaaatatattttaaaatcacatttgttaatactgtattattactgatctcatcagacaattctttaagtattgggaagctgccaaactcatagtaggcagttaaaggttttctaaaaaagtctaatttacttgaaagttttaattttgtcatagacaacaagtatttccaactgtgttctttgaagtcgtaggtttattttattttgtatgctaaatacccatgtctgaatagcccttttttttctgttcatccttttgtcttccaagtaaaaatgatgttccatgaaaaatgcctctagttcagcttgcaactcaaacaattgcataagggcttttcttcgaggtagctattgtaattcagtatgtagcagggatgcttgctgtgtacttcccattttgtcacacagaatgttaaacctgtatacaacatttgagatgtgataaattgaataatttttactgtattacccaggacattcttcagtgaaactgacctttaattttactgtgatacatggtggtgaagaatatgatgactataagtacagtttggtgccactgccttaatttgtgctaaggtgccagcagttttacctaccattgcttttgaaccatcagtggaaatgtcagcccagtgaaaaaacaaatactatattcccaccccccaaaataatatctttgtagaattataaaaatagttttaccctcttggatcatctgaaagattcttggggatctccagagagaaagggccaataaccaaccatatttggagaattgcttgtttaatggaaagttctttaatcaaaagtcagaattcttggtttctaggttagtaatccttgttatagatctcaggaaattactgacttcatttttgtttcttctccttttattaaagtgatgtggaagtgagtgctgtaaaatagtttgtgtctaatgtcaggaaataccttattaggcacggcacattgtaaaaaaagttctggagagatttgaactaggtctttccttttcattcattttatttattatagtgatgttaaggtggctggaattgataacctatttttgtaaaacttctatttttacaaaaatgtaccaagtgataattaactaagacagtggagtcatgttggaatatagtctataagatacaaaagttgtcctcaagctacttgtagcctgattaataaacacacagatatagcagtataatgtattttatgctatcacataattgctttaaataatatataggagatcagagaatgacaagactgacgaatggggaggtagagagtggctccatgaagatcatagaattaaattagacctttataaaaatggagaaatgatatatgccgaggtacaaagagaacatgtcatacttctcaattaatcttttcccttcccagacaaatacctatcctcagtttccctcttcctgtcattctgtggtttgtgacatcgtttttctcgtacttcttttctttggaccattctaaggcccatgatttgtgctattaagatagcatggtgtactggaaagatcttgggctttggagtcagagtgacccaacctgcaattctgagagcacatttcatagacagtctgaaaattaagtgaaataatacatttaaaggtgctccataaatgttaactgcctttctctattattacaaataatgaacagcaacagagaatgagttaattaagatggtagcatgctgtgatgaaatttatccattagactgggagagcaaaagacttgtgaaaagagagacaataaggtattgtggttatcatggacattagagatggagagaattgtagtaaaatcctgattgtaacctgtactattacctttgtgtttattttgggcaagttgacttaaactctcaaagccttagtttatttatctaataaatgggaatggttttgggaagatagtcaatagatccccccacatatttgtttattctttattcgaatgtgattttgttcagtcctgggggatattgattaggctaggctaatcagtgaatgccattagttggtgacctagtctttggtgtaagatgattatgtgttcttgttgacatttatagatcatgaatatcttgacacactctgcctagttctagaagtccctccatatacctctttcaaagcctaaaatatttatcatctgcccctttatagaacagttttccagtttctgtcgtatgcatttaagttacctggaatcagtttggttattttgaggcttttgagcttccttgggtgggtccagagcagcctttagtgtcaagggctaatttacccctttactaaggcaatatctttctaatgactctctacccaatgctccatgtattgtgagatctttcccctttgactgatgggaacataaactgttctcagctgtgtgcaatctctgggaattatacagcttgtatctccagtgattctttccccaccattgggtaatttttctcattcatgtgaaaactccacaggacccctctgcagttgtggggagttctctctctatgtctcctttctccccagtattctgctccataaattccagctgccttggcttcccctaactctcattttcttttctcaactcaccaagatgaatgggctctgtttggattctccctccctgtttttcagcctggaagctgtctccaggacaataaactggggcagtcatagagctcatctcacttgtttttcttttttcaggagttatagtcttccctgctgtaattccatgtctaaaacatagtttttatgttttgtccagttttctagttttttacaggtgtctgtgtgtgtgtgggttggggggctactcaggggttaagtcccatttctgttgctcttttatggccaggagcaaagctccatttatagctgttacttttttttccctctatgtattctctacaccactaaaaagtcagatgaatccatcatctgtataatcacgtttgtttttatagcaattaagtgccatagccacttgtattagtatgggttctccagggaaatagaaccaataatacacacacacacacccccaccccaccccccacacacaaagagatttattataaggaattggctcacataattatggaggctaagtcccaagatctacattcagcaagctggagacccagaagggctaatggtgtagttccagtatgaatccaaaggtctaagaaccagtatagccaatgatataagttttaggtgctgtaaattccagtctgagtccaagtccacgtccaaaggcagaaaaccgacatccaagctcaaagataggcagagagtgaattctcccttattccacccccgtttttttttctattcagggcttcaatggattggatgatgcccacccacatgaaggcgggcaacctgaattacttagtttaccaattcaaatgttaatctcatccagaaacatcctcacagacacacccagaataatatttaaccaaatttatgggtatacggtggcccaaagtgacataaaaattaatcatcatactcctcaaactcttagggttgcccttcatctaagttgtataataatgaatcagtacctgtgttcccatttcctcccagcatggagataatcctggagtttctagattaatctcaatctcattttgacggttgtttcctggggctactttccaaccaaaacacatagcatattcagaataatttgagagggactatttacaagatgtgggagaagtgtagggaaacaacaacagataggatagtaactgatgagcaatactggagcagtttactgtccctacacctgaagagttggggggaaggagtatccaaatctgagagagagtcttgtagagatgtctgccttcggaggaacaatgacacttggtggaggacctagccagcctggggctaccctacagagaggaagccaggaaattaaattccttgaccaccctctcctccttctttctgatctcctgcttttgaggcagtctgtatagaaacccctggggcggcagcgggcagagtgaactggaggggcagttggaaatatttggcaaagacagctaggttggagtagctgcctggcccctttcctttagaaacaggtgtttcaagatacacaaagtttgaaatgagagaaaaaatagtttatagattattattttcttgcctttctaatactcccaaagtagtcttccatgtatgttctgaagaactgatgaaagcaagaagaaataatgttaaattatccagagttgtttaaactcatcagcagatgctgttattttattgataaagctggtgatattaaaaattaatcaagtttgcccattgtagtaataggtcaggatttagatactccataatccacactgtattttaagaaaagtatccatagggaaagaagaaaatattcacgtccataaaagtggtttatttaacattgaagcatagtagtggcaaatatttatatgttaatctatattttacatatttctacttttaaattattaatagacatggatgggtaattttaggtttaattcagactttctgtaagtcatttagaggaagctcagtgtgaggcattctttgctataaacagaatgggtgaacatttactgggtgatatctggtaattagcaacaaatttggagcatccaggaaagatgctgctgctttgcatctttggctgtgtatgccactcagtttgtggaaattcagtcctgtttttaggtgcatagtgcatggcctttgacctacctctctgcagcagtatcttcaaaccaccttcacctcttgcaactggcagccgaggtgggttgcatggtgcagtggtgctgttaccacacataaccacagattatcaccaaacatataacgtattctaaaaataaaacacttttaaaaaatttcagaaacatatttgagcattttaataactgagtagaaattagtcgtagttttataacattttagagcttggagagatctttgcaagtttattttactgatgagatttagatacagtcacatagcttatttaatgattgagattcagtcacgcgcattattagtgaagtgccaacataagaaccaggatcttctgattaccttcagtgattttattatgcaaagcttttgctcgttgtagatattcagagttacagaatccacaaatgcattataaataatggtctggcatcaacactgagggagattttgttgttccatgacagctctatttattaactggtttttccttattttggtcaaaaacttgcttcctaataactttcacatattattcctagtcctgtcctcatgagaatcacctaattctttttcctttgataacctctgaaatatttgcacactgtgatgagctcagaaaaacaactttaggtctttagctttttcttatataatgcaattttcgatataattgccgttctggttgcctttctagccatggatcactttgtcagtatcccacctgcttagggttcccaggtttgaacgttgtgtccaggcatattctgaagggatatagtgaatgcacttttagtcacccaatataaaatggtgggcaatacagtaaaagaagaaaagcgacaaaatcagttctttttttttaatttaattttattattattatactttaagttttagggtacatgtacacaatgtgcaggttagttacatatgtatacatgtaccatgttgagtttgctgcacccattaactcgtcatttagcattaggtatatctcctaatgctatccctccccccaccccccaccccacaacagtcccgagagtgtgatcttccccttcctgtgtccatgtgttctcattgttcaattcccacctatgagtgagaacatgcggtgtttggttttttgtccttgtgatagtttactgagaataatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgctataaacatacgtgttcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctctgtcagatgagtaggttgcgaaaattttctcccattttgtaggttgcctgttcactctgatggtagtttcttttgctgtgcagaagctctttagtttaattagatcccatttgtcaattttgccttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtgtaaggtgtaaggaggggatccagtttcagctttgtacatatggctagccagttttcccagcaccatttattaaatagggaatcctttccccattgcttatttttctcaggtttgtcaaagatcagatagttgtagatatgcgacgttatttctgagggctctgttctgttccattggtctatatctctgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattcgtagcttgatggggatggcattgaatctataaattcccttgggcagtatggcgattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggcgttcactcatgatttggctctctgtttgtctgttattggtgtgtaagaatgcttgtgatttttgtacattgattttgtatcctgagactttgctgaagttacttatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagctttgcatcgcagggatgaagcccacttgatcgtggtagataagctttttgatgtgctgctggattggtttgccagtattttattgaggatttttgcatcaatgttcatcaaggatattggtctaaaattctcttttttggttgtgtctctgcctggctttggtatcaggatgatgctggcctcataaaatgagttaggaaggatttcctctttttctattgattggaatagtttcagaaggaatggtaccagttccttcttgtacctctggtagaattcggctgtgaatccatctggtcctggagtctttttagttggtaagctattgattattgccacaatttcagagcctgttattggtctattcagagattcaacttcttcctggtttagtcttgggagagtgtatgtgtcgaggaatttatccatttcttctagattttctagtttatttgcatagagttgtttgtagtattctctgatggtagtttgtatttctgtgggatcagtggtgatatcccatttatcattttttattgtgtctatttgattcttctctctttttttctgtattagtcttgctggtggtctatcaattttgttgatcctttcagaaaccagctcctggattcattaattttttgaagggattttgtgtctctatttccttcagttctgctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctaccttcatttcgttatgcacccagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcagtgttggaataggtgtggtgtggtgctgaaaaaaatgtatattctgttgatttgtggtggagagttctgtagatgtctgttaggtccacttggtgcagagctgagttcaattcctgggtatctttgttaactttctgtctcattgatctgtctaatgttgacagtgggaagttagagtctcccattattattgtgtgggagtctaagtctctttgtaggtcactcaggacttgctttatgaatctgggtgctcctgtattgggtgcatatatattaagatagttagctcttcttgttgaattgatccctttaccattacgtaatggccttctttgtctcttttgatgtttgttggtttaaagtctgttttatcagagactaggattgcaacgcctgcctttttttattttccatttgcttggtagatcttcctccatccttttattttgagcctatatgtgtctctgcacgtgagatggatttcctgaatacagcacacggatgggtcttgactctttatccaatttgccagtctgtgtcttttaattggagcatttaggccatttacatttaaagttaatattgttatgtgtgaatttgatcctgtcattatgatgttagctgcttattttgcttgttagttgatgcaatttcttcctagtctcgatggtctttacattttggcatgattttgcagcagctagtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggcttcccttaacattttttccttcatttcaactttggtgaatctgacagttttgtgtcttggagttgctcttctcgaggagtatctttgtggcgttctctgtatttcctgaatgtgaatgttggcctgccttgctagattggggaagttctccaggataacatcctgcagagtgttttccaacttggttccattctccctgtcactttcaggtacaccaatcagacgtagatttggtgttttcacatagtcccatatctcttgaaggctttgttcgtttctattcttttttctctaaacttcccttctcgcttcatttcattcatttcatcttccatcactgataccctttcttccagttgatcggatcggctcctgaggcttctgcattcttcacgtagttcttgagccttggctttcagctccatcagctcctttaagcacttctctctattggttattctagttatacatttgtctaaattttttttcaaagtttttcacttctttgcctttggtttgagtttcctcccatagctcggagtagtttggttgtctgaagccttcttctctcagctcgtcaaagtcattctccgtccagctttgttccattgctggtgaggaactgcattcctttggaggaggagaggtgctctggtttttagagtttccagtttttctgctccattttttccccatctttgtggttttgtctacttttggtctttgatgatggtgatgtacagatgggtttttggtgcggatgtcctttctgttagttttccttctaacagacaggaccctcagctgcaggtctgttggagtttgctagaggtccactccagactctgtttgcctggatatcagcagcggtggctgcagaacagcggatttcgtgaaccgcaaatgctgctgtatgatcgttcctctggaagttttgtgtcagaggagtacccggctgtgtgaggtgtcagtctgcccctactggggggtgcctcccagttaggctgctcgggggttaggggtcagggacccacttgaggaggcagtctgcccgttcttagatctccagctgcatcctgggagaaccactgctctcttcaaagatatcagacagggacatttaagtctgcagacgttactgctgtctttttgtttgtctgtgccctaccccagagatggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagagagactccgtggacataggatgggattatatccaggtgcgggatataatctcctgatgcgccgttttttaagcccgttggaaaagcgcagtattagggtgggagtgacccgattttccaggtgctgtctgtcaccctttctttgactaggaaagggaactccctgacccgttgtgcttcctgagcgaggcagtgcctcgccctgcttcggctccggcacggtgcactgcacccactctcctgcgcccactgtcaggcactccctagtgagatgaacccggtacctcagatggaaatgcagaaatcacctgtcttctgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaaaaaaaaaagaaacactaattagattaatcatcaaattcccttaatcttttcaaaaatttattttaaaattttatctgtttattaattattttgttgatacataatacgtgtgcatattttcagggtacatgtgttaatttgatacactcatgtaatgtgtaaagaccaaatcagggtaatggggacatcgatcaccttaaatccatttctttatgctaataagaacattagaattattctcttctagctattgtacaattgattaatgttaactgtagtcaccctactgatctattgaataccaggtcttatttctttttgtttttttgtttttctttttgtttttgagacagagtcccactctgtcaccaggctggagtgcagtgacacgatctcagctcactgcaacctctgcctcctgggttcaagtgattcttctgcctcagcctcccctgtagctgggactacaggtgtgcaccaccacgcccagctaatttttgtatttttagtggagacagggtttcaccatgttggccaggatggtcttgatctcttgaccttgtgatcctcctgcctcaccctccctaagtgttggaattacaggcatgagccaccgcgcctggccaatcttatttcttttatataactgtgtatttatttgtactgattaatgaacctctcttcatcactcccttacccccttttttcatcccttcttggcctctggtaaccaccagtctactactctttatcttcaacaaatccatattttttaacttccacatatgagtctgaacatgtgatatttgtctttctaggcctggcttatttcacttaatgtaatgacctccagcttcactcatgttattgaacatgacaggattccattcttttttatggctgattaatattccattgtgtatatatgcataatattttgtttatccatatgcctattgaggagtacttaggtttattccatattttaggtcttgtgaatgatgccctgataaacgtggaagtgcagtatctgtttgatatattgattttctttattttggatatatacccagcagtcaaattgctggatcaaatggtagttctatttttagttttttaaggaagctccacactagtttccatagtggctgtgctaatttacattcctaccaacactgtaggagggtttccctttatttacatcctcacctgcatctgttacctcatgtccttttgacaaaagccattttaactggccgttttatactgtgttattgtggttttgatttgcatttctctgatcattagtgatgttgaacattttaaaaatatacttgttggcctttgtatgtcttcttttgagaaacatctattcaaatcttttgcctatttaaaaatcaggttattattattttactattgagttgtttgaactcctgctatgttctctttattaatcccttgtcagatggatagtttacaaatattttctctcattctgtgggtggtcttttctccttgttgattgtttccttagctgtgcagaagctttttagcttggtatgatcccattcatttgtttttgccttggttgcctgtacttttgagttcttacatttaaagatctttgcccagactaacgttctggagcatttacttaatgttttcttctagtagtttcatagttttaggtcttgcacttaaatatttaatccgttttaatttgatttttgtacatggtgagaaataggggtctaatttcattcttcctcatgtggttacctagttttctgagcgctgtttattgaggagactgtcctttccacagtgtatgttcttgggatctttgttgaaaatgagttggctgtaaaatgagtgtggatttatttatgtgttctctattctgttccattggtctatgtctgtgtttttatgccagtactatattgttttggttactgtaactttgtagtatattttgaagttaggtagtgtgatgcatccatctttgttctttgtgctcagggttgttttggctatcctgggccttttgtggttctgtatacatttttggattattattgctatttttatgaagaatgtcattggtatttggtagggattgcattgaatctgtaatattaattcttccaattcatgagcatggaatatcttccctttgtaaaaatgtcctcttcagtttctttcatcagtgttttatggttttccttgaatagatgttttacttctttggtgaaattgatttctaagtattttatattctttgtagctcttgcagatggactgctttcttgatttcttttttagattgtttgctgttggtgtatataagtgctactggtttttatatgttgattttgtgtagtgcaactttactcaattcatttatctgtcctaacagttttttggtggagtttttaggcttttctatgtataatatcatgttatctgtgagcaagactaatttgatttcttcctttccaatttgtatatgctttatctctttctcttgcctcattgctctggccaaaacttccagtattattgttgaatacaagtggtgaaagtgggcatcttgtcttgttccagatcttagatgaaaggttttcatttttttctttgttcaacgtgatgttagctgtgggttatacggcctttattattttgaagtgtgttccttccatacccagtttgttgaggatttttatcataaagggatgttgaattttattgaatgcttttcagcatgtattgaaatgatcacatgatatttcctcttagttctgttgatgtgatgtattacatgtattgatttccgaatgttgaaccattcttgtatccctgggatgaatcccacttattcatggtgaatgatatttttaatgtgttgttgaattcagttcgctgctattttgttgaggatttttgcatctatgttcattagtgttgttgggtctatagttttctttttgttgtgttcttgttttattttggtatcagggtaattctggccttataggatccgtttggaagtattccctcttatttattttttttgaagagtttgaatagaattggcattacttctttaaatttttggtagaattaagcagtggaaccaccaggtcctgggcttttctttggtgggagactctttattatggcattgatctcattacttattggttagttgaagttttctgtttctccctggttcaatcttgataggttgtatgtgtccagcaatttatccgtttcttgtaggttttccaatttgttggtgtattgttgtttcttataattttaaatgattctttgtatttctgtggtttgagttgttatatctcctttatagtttctgattttattttttttgggtcatccctcttttttcttagttaatctagctaaagatttgtcaattttgcttgtcttgtttaaaaaatcaactttttgtttcattgatcttctgggtttctttcagtatcaatttcatttatttttgccctgatctttattatttcttcccttctgttaattttgggttggcttattctttctttttagtttcttgagatgcattgatatgttgtgttaagttatttatttgaagtctttctttttttaaaatgtaggtgtttattgctatagacttccatcttcatactgtttttcctgtaccgtagattttggtatgctgtattttccattttcagttgtttcaggaaatttttaaattttcttcttaatttcttcattgacccattggtcattctggacatgttgtttaatttccatctgtttgtgtatttttttgtggtgtctcctattagtagtttctagttttattccactgtagtccagaaagatacttgatatgatttctacttttttgtatttgttgagacttgttttgtggcctaagatttggtatcttctggataatgttttatgtggcaataaagagagtgtatgttctacagttgttgggtgaaatgttctgtaaatgtcagttaagtgtatttggtctagtgtgcagtttaactctgatgtttgtgaattttttgtctagatgatccatcctttactgagagtagggtattgaaatcccctactattaccatattgcagtctgtctcttcctttagatctattaatgtttgctttatatgcttgggtactgggtattggatgcatagatatatatagttattatatcttcttggtaattgacccctttattattattgaatgaccttgtttgttcttttttgcacagtatgatttgtagtcatcttacctgatacaaatatagctattcctgctctttttaaagtttccgattgcatggaatatcttctccaatctccttactttcagtttatgtgtgtctttatatgtgaggtgcatttctttttcttttcttttttttttttttgagatggagtctcgctttgtcgcccaggctggagtgcagtggcgcaatcttggctcactgcaagctccgcctcccgggttcacgccattctcctgcctcagcctcccgagtaactgggactacaggcgcccgccaccacacccggctaattttttgtattttttagtagaggcggggtttcactgtgttagccaggatggtctcgatctcctgacctcgtgatccgcccatctcagcctcctaaagtgttgggattacaggcgtgagccactgcacccagctgtgaggtgcatttctaataggcagcatatagttgggtcttatttctttgtctcttcagccactttgtcttttaattagagatttgagtccatttacattcagtgttttcattgataagtaaagactttactactgccattttgtttcttattttttggttgacttgtaactcctctcttcctttgttattgtcttcttttgtggttaaccctgagttttctctggtagtatgttttaatttgttgctttttaatattagtttatttattataagtttttgcaatgtggttagtatgagacttgcaaaaaaacataacaagctattttagtgagagattacaacctgggtcagatcacaaagaaataatagaaacaaataaagaattttttaaaacttctatactttacacccccccccccacattttgacttttgttgtgtcattttacgtttttattttacctgtctcttaacaggttcttatagctattactgttttcgatagatttctcttttagacgtcatgctaaagttatgagtggactacataccataattatagcattagatagagtatcctggagttatctgtgtactaatcttaccagtgggttttatacttttaaatgttttcttttgcacattagtggttttttctttcagattgaagaactccctttaggatttcttgtgtgatggatctggtggtggtgaattctctcattctttgtctgggaaagactatcttttcttcatatttgaaggatagctttcctggatatactattcttggatggcaagtccccttcccttccctgcccttcccccgctttttttttgagactgagtcttgctctactgcccacgctagagtgcagtggcatgatcttggctaactgcaacctccacttcccagattcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttatatctttgtagcatttggaatgtttaattttttaaaaaaataagctttgtatccctttctcttgctcagctccctcttcagcaccaacacttctcaaatttgttttttttttgagataattttctatatcttgtaggcaatctttgttccttttctttcttttttctcctttgtgtgttttcaaatagtcttgtttttgagcttactgattctttcctttgcttgatccagtctgctgctgactacttctaatgaatttttcacttcagcaaacatatttctcagtttcaaaatttctgcttgatttatttttaatatttcagtctctttgttaaatttctctgttaaatttctgacttgtttttctgtgttatcttggagatcactgagtttccttaaaagtgctattttgaattctcggtcaaaaactcacatttagccatcttgttagggccagtcattggttccttggcttgtccatttgaggaggtcagttccctgtttgctgtttcttgtggatgtacatctatgtatttgcaatgaaggattagttatttattccagtcttccgtctctggcttgctttggtttttattggatatgtttctttagagtttgtatttttgaatttcttttttttcttgttaggttgctgccccctttttggcactaaatggcaccttaagcccaggtttgcctgagctctagtattcagtatttgatcagagcactgcccatctcaaatgggggaggtctcaaatggaatattctggcaatgttggaaggctggctaggggtttgtgcacaggggacctgtgtaacacacctcctacaatgtggtgctgctgaacagtcagtctgatttggcatttcctttgacagagttacagatcagagtttccagggctagggatggtggtcccacctcccctcattgcctttggctgtcctcagggatatttctccctttaggcgttcatgatgcttcctgtgggttgaggctgggacagatcttctgccaaggaacccaagatggtggggaaactgattgtccactttgaactcactgttttcagccgttttggctatctagcttatttgtacccattgaaaatgtggactgttttcttggccttaccacgatatctggtcaccttttggaaaaggctacttttaatttcttatggttaataaggttgtacatgtagccatccattaaagccaagtaataaataaaggtggacacaaaacaatctgttttatagccataagttatagtatacctaattgttggttgtcattttgtaaaagtaataacaataagctaaaaactgatttttctgttgtatcttttctgtcagcaaaatgaattagctttgtgatattgaacaagatgaaaaagagaagaaaaggaggcagagtccaatcagtcagtaaaaagatttagtggaatctgactatggtgtacagaatatcatcaattcaaaccaggcaattaaaagttgtattaagaggttgctttaaaaaattaaaagtatgtatgatatattgggttgtaagaaaagccatggactggaaaaatcctagtaccataagaaggaaattcacatgctagtcaggtagaactctcctggaagaagcgcctaggtcctgtgtcttgatgcactgactgataatccatattcctacaccatatcttggtaagcatactacctatgtttatgatgtaaagtaaatccatcagtactaacacttttaacattatgtttgggaataagttttatagtcgtggtgatattacatgtgtgtatttgtgttaaaggtgttttgaaacctttcagacatatcagataatctgccctgttagctttgttattttaacttgaaatatttaattcaaattaaacatagactatacattaactatgatcacatttggttgtgaacgaaggaaaacccaatgaaatagtaggttaaacaagatagtttattactgtttcacatgagtgaggcagtccattcactactgatatgttagttctattctgcaaagtcctcaggatcgaagtcttgtttttgttttgagacagtctcgtgttttcgccaggctggagcgcagtggtgctatcttggctcactgcaacctccgcctcccgggttcaagcaattctcttgcctctgcctccccagtagctgggattacaggtgcccaccactacacctggctaattttttttatttttagtagagacggggtttcaccatgttggacaggatggtctcgatttcttgacctcaagatctgcctgcctcggcctcccaaagtgctgggatttacaggcatgagccaatgctcctggccccaagttttgtttttttacttcactgttacacaatacttaggaggattttaatatgaaagatgtaaaataatttggttaaatttctaaacagtgtcagaacctttaagataattggatttattccacttattagtttggcttattaaatttacaagagttgcttatgtattttggttgttagatttgcaaggctaccctgtcgctcatttgaaaggtttgagaaaatcagatttatttgatttgtaaatttagttttaaatgttttaggcaacttaatttcactggtttataattgaagataattgtttaggggaatttaatctgtaatgattgaacatgaagataaaatgtgaaagtaattgtttatatttttctagtaaaattataaatgatatacgcaacaagatttgtgaaatgaacttttaagttttgcacttttagagttttgaaattttaacttttaaggtttgcaaaaagtttaaaaacatacaactttaaatatgtgatacaagtaaccatttttgtataataaagtctcacctaagttgacatttcagaaattaaaaatatgaggagataaggtattatgcacatgctgttgagactgctgaagttattttttaaaaatgttaagtatacattttatgttgtcaagaaggagcaaatactctttttaatatttgcatagtatcttccattagactttaacacccttagctctttgcctttaggagattcaaattaaaaattcactttttttttgttttgagacggagtttcactcttgttgcccaggctggattgcaatggcgcaatctccgctcactgcaacctccgcctctcaggttcaagtgattctcctgcctcagcctcctgagtagctgggattacagacatgtgccaccatgcccggctaattttgtatttttagtagagatggggttttgccatgctggtcaggctggtcacaaactcccgacctcaggtgatctgcctgcctcagcctcccaagattcactttttcagggataatcatgttgtcaaaaatattagccatgtatacagagaaagttgataagacatgaattagtttgtattgatataagttcaagtaattgcatatgtgtgtaaagatagagcctaactaaataagcttcttttgggaatggctttctttcttttttttttttttttttttgagacggagtcttgctgtgtcacccaggctgcagtgcagtggcacagtctcagctcactgcaagctccgcctcccaggttcacaccattctcctgcctcagcctccgaggtagctgggactacaggcgcccgccaccacacccggctaattttttgtatttttagtagagacagggtttcacagtgttagccaggatggtctcaatctcctgacctcatgatccacccatgtcggcctcccaaagtgttgggattacaggcgttagtcaccgcacctggccccaggaatggctttcattgaaaaaatactgtctccatacttaatgtctattagctacttctttgaaggagaaatgtaattaaaatgcctgtgtttaaaagcggctttaaattattaacactgtcttagtccatttaagttgctatagaagaattcctgaggctgggtaatatataaagaaaaaaggtgtatttggctcatgatttttctggctggaagattgggcatctagtgaaagccttaggctgcttctactcatggtaaaggaagggaaactagtatatgcagagatcacaacgtgagggtggaatcaaggagggcagcaaggtgccaggctcttttttaacaaccagcacacataggaactaatagagatagagcttactcattaccatgaggatagcaccaagccattcatgagggatctgtcgcacaacccagacacctctcattaatccctgcctctaatgatggagatcacatttcaacatgagatttggagaggccagtatctaaactatagcagatactgttccacgtctttggatttttttttgttttttgagacagagtcttgctatgttgcccatgctggagtgcagtggcaggatctcagctcactgcaacctctgccgcctgggttcaagcaattcttgtgcctcagccaactgagtagctgggattaaggctggtctcaaattcctggcctctagtgatccacacttcttggcctcccaaggtgctggcattacaggagtgagccaccacaccctgcccagatctttggatattttttgaaatgtgaaattacttctcaaattttatcttaggttttttagcatgaatcacattttttttaaggatgggttatctcaggtattgtgtaatacacatttaaagtttctttcttttgtaacctatggaatggtagatggtatttttaaaccacacatctgataaagggttaatatccaaaatatttaagaaacttaatagcaagaaaacaaataactgtattgaaaaatgtgtggccgggcgtggtggctcacgcctgtaatcccagcacttttggaggctgaggcaggtggatcacaaggtcaggagatcgagacaatcctggctaacatggtgaaaccccatctctactaaaaatacaaaaaaattagccaggtgtggtggtgggtgcctatagtcccagctactcaggaggctgaggtaggagaatggcatgaacctgggaggcagagcttacagtgagctgagatagtgccactgcactccagcctgggcaacagagcgagactctgtctcaaaaaaaaaaaaaaagaaaaaaagaaaaatctgcaaaggatctgaatagacatttctcaaaagaagacatgcaaatgacccataggtgcatgaaaaaatgctcaacatcactaagtgtccatcaatgaatgaatggataaagaaaatgtggttgaatgaatggataaagaaaatgtgatatatatacagaatatatcatatatatactactcagcctcataaaagaaagaaattctgtcatttgcaactatatgagtaaagctggaagacattaagcttaatgaaatagccaggcatagaaagacaaatatcatgtgatctcacttatgtgcggaatctaaaaaaagtggaactcagagaattagagagttgaatggtggttaccaggggttccaaatgggagaatggggagatattggccaaaggacacaaagtttcagttaggtaggagaaataagttgaggagagccattgtacagcgtggggactgtagttaaaatactaatgcattgtgcacttgaaaattgctaagagagtacattttaagtgttctcaccacaaaaaattgacaagcttatattaataagcttgattgaatcactccatagtatatacatatatgagaacattgctttgtataccataaatatatataaattttgtcaattaaaaatgattaaaaaataaagttgctttttctttaaatgatggcatttatataaagtaataacatttctaatatgtgtgccctgattttaaagacatcaatatataaaaaccaaaatttataaaaccatcaagtttgtgagttgcgtttttaaattatggagaggttttcctttgtaccaaagaccctgtgacaaggccaaatcctataatttccttcatagcactagttttggttacaaatttacatttatctagtgattgtgtatcgggggaactcaccccccatattttaacataggttctttctattttccctacgtgtcagccggtctgagaaataaagagaaagagtaaaaaaagaggaattttacagctgggcctctgggggtgacatcacgtatcagtaggactgtgatgcccacctgagccgcaaaaccagcaggtttttatcaaggacttcaaaagggaagggggtgtacgaacgggaagtgggtcacaaagattacatacttcaaagggcaaaaagagaacaaagatcacatgcttctgaggaaacagggcaaggacaaaagcaaagatcacaaggcaaagggcaaaattagaattactgatgaggttctatggtcagctgtgcacgtattgtcttgataaacatcttaaacaacagaaaacaggctttgagagcagagaactgttctgaccttaaattcaccagggtggggtttttccccactctagtgagcctgagagtactgcaggagaccagggcgtactttggtccttatctcaactgcataagacagacactcccagagcagccgtttatagacctcccccgaggaatgcaattcttttcctagggtcttaatattatattccttgctaggaaaagaatttagcgatatctctcctacttgcaggtctgtttataggctgtctgcaagaagaaaaatatggctgtattctgcccgaccccgcaggcagtcagaccttatggttgtctttccttgttccctgaaaatcgctgttattctgttctttttcaagatgcactgatttcgtattgttcaaacgcacatgttttacagtcaatttgtacaatagtggtcctgaggtgacgtacatcctcagcttatgaagataacaggattaagagattaaagtaagacaggcataagaaattataagagcattatttgggaactgataaatgtccaggaaatcttcacaatttatgttcagaggctgaagtaaagacaggcataagatattataagagtattattagggaagtgataaatgtccatgaaatcttcacaatttgtgttcctctgctgcggctccagctggttcctctgttcagggtccctgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattacttaaaaatgctaatgatcattagccttcagtgaatggtaatctttttgcctttggatggtgttgcctgcatgtgaattgctgctgactgatcagggtggtagttgctgaatgttgggttgggtatggcaattaacttttttttttcttttttttttttttgagacagagtctcgctctgttgcccaggctggagtgcagtggcatgatctcagctcactgcaagctccgcctcctgggttcatgccattctcctgcctcagcctccagagtagctgggactgcaggcacccgccaccacacctggctaattttttctattttttagtagacatggggtttcacagtgttagccaggatggtctcaatctcctgacctcatgatctacccacctcggcctcccaaagtgctgggattacaggtgtgagccactgtgcctgccccggctatggcaatttcttcagacaaaaatgatgtttgtcacattgattgactcttcttttcatgaatgatttgtctatagcatgtaatgctgtttgatagcagttacccacagtagaacttctttcaaaattggagtcaattctctcaagccctgtcactgctttatcaattaagtttatataacattctaaactttttgttgtcatttcaacaaagttcacagcatcttcacagagtagattccatctcaagaaagtactttctttgcttatcataaaaagcaactccttatctgtttgttttaccatgagattgcagcaattaagtcccatcttcaggctccatttctaattctagtctcagtgtcatccatgagggttggaatcaacttcttcctaactcctgttcattttgatactttgatcccctccaatgaatcatgaatgttcttaatgacatctagaataatgaatcctttccaggagattttcaattgatagatccgttagaggaattactatctatggcagctttagccttatgaagtgtatttctgtaataataagacttgaaagtcaaaattacttcttgatccacaggctgcagaatggatgttttgttagcaggcatgaagacaacattcatctgattgcacatctccatcagagctcttgggtgtccaggtgcattgtcaatgagcagtaatattttgaaaggaattggccgggcatggtggctcacacctgtaatcctagcactttgggaggctgatgcgggtggattgcctgagttcaggagtttgagaccagcctgggcaacatggcaaaaccccgtctctactgaaaatacaaaaattagcaaggcatggcagagagcatctgtagtctcagctactttgggtgctgaggcaggaggatcacttgaacccaggaggttgaggctgcagtgagccgagatggtaccactgcactctagcctgggtgacaaaaaggtttcaacagtgggcttaaaatattagtaagccatgctgtgctgtcagccaggctttatttttccatttatagagcacaggcagagtagatttagcataatttttgagagcccttgtattttcaaaatggtcagtgaatattggattcaacttaaagttaccagctgcattagcccctattaagagagtaaacctattatttgaagccaagcattaacttttttcccctagctgtgaaagtcctggtatcttcttccatttcatctacattgaagatctgttgtttagctacttccttccattatcttagctagatcttctggataacttgctacaccttctacatcagcacttgcttcttcaccttgtacttttatgttatagagatggctttttttttcttaaacctcatgaaccaatatctgctaccttccaacttttcttctgtatcttcctcacctctctcagctttaatagaattgaagagagttagggccatattctagattacattctgggttaagagaatgttgtggctggtttgatcttctatccagaccaataaagctttctctgtctcagtgatagggctgttttgctttctttttatttatgtgttcatgggagtagcacttttagtttcttacaagaacttttcctttgcattcacaacttggctgtttggttcaagaggcctagctcttggcctatcttggtttttgacacaatttccttaccaagcataatcatgtgtatcttttcatttaaagtgagaaacatataactttttatttcacttaaacacttagaagccatgatagcattattaattggcctgatttcaatattgttgtctgaaggaatagggaggcctgaggagagagagagagagatagggggatgggctggtcagtcgagcagtcagaacacacacacaacatatattgaataggtttgcatcttatgtgggtgcagttcatggtgccccacaacaattacagtagtaacatcaaatatcaccatgatagacatactaataataaaaaagtgtgaaatattgtcagaattgccaaaatgtgacatatagaaatgaagtgagcacatgctattggaaaaatggcaccaatagacttgctcaatgtagggttgcacaaacctttgatttgtaaaaaatgcagtaactgcaaagtacaataaggcaaagcaaaataaaacaaaagtatgcctgtagaaggcactcaataaatatgttgaatgagtgagtgaggagaaagaattgtcttatgtagtaagcctttaaaatcaaattcctttttaaagaaatgtaatttttatgcagtcttttttagcggtacagctattatataaattgataattgcctaaatattaaatggcacagaatgaaatctttaatgtagtcactgttctagaaatacttcaaatgtagccagtaaccaaaatcaccagacccccaacatccaaagttttattacctgtgtgggcagcctccaatttaatgtggtatggcagtcattgatgactgtgctttttattacttctttactatgatttcttatctatatactctgatatatgggccattcatataagctttcaaatctctagtgtaactaaatgggtaatatagtaaggcttttattatctaaacaatgtttattgaaaagagtttgcctctaagtatttgtaagtatattatctttcaaaacaaattcggtttatataagtcttatagccacaatgttataaaggccacaccgaagccagtgtcttgtctttggctgtacctctatttattttctatttttgtccttcattgggtctttttatgcaggcagtcataatttggtctttttaaaatgtttaatacaggttaaagccttaaacaggttttttcttgcttcataatatacacatgaacaggcattttggtcactataacaagtgtaattttgtgtttagcccttgttatagatatctttttcttatctcagtatgtcattcatatttttctaacttgctgctcaacactcttcttttttactactcatgggtatgtattgctagtgagttttaaattccagctcttgaattccttgtacttgtagcttactattgctacttaaaaatgctacttcaaaaacttgagaatttgctacttcaaaaacttgagaattttagaagtcagaactaatagaagaaaaagagtcttatacatcatatgaatttgataaggctggaaatgtcccctataaacagaaagattgagaataacagaaatctacctaaaagatatgtcagaacaaacaaaaaaattcaactactgtttaaaagatgattcatattaattacagagtaacttgatatatcagaacactgttaaatcattccagggaaattgtctgggcatcttcaagcaatagaaagaaacctgttttcatattagctaacctttcaactgtgtgttatctattaatctcatgtatgttggagtaactgtaaacctcctgcttcttggatatgtatgtgaaaagaatatggcacttaatgaagaaacaggccttaactgaaatacttaatgtttctgttgctagctttttaactttgggcaggttagtttaatattctgatcttcggctattccatatgcagtatgtcatataaagacttcatttgccatatgaagacagtttgcccaaggtcacagatagtgactaatttatgataataaataatatttcactgcactaaaaatggctgatgatcaaatataggttatggaagttttctttaatagctttttttttttttgaaagggagtctcactctgtcacccaggctggagtgcagtgacgtgatttcagctcactgcagcctccaccttctgggttcaagtgattctcccacctcagcctcctgagtagctgggacttcaggcacgcgctaccatgccggctaatctttgtatttttagtagggacggggtttcaccatgttggccaggatggtcttaaactcctgacctcaagtgatccacctgcctcggcctcccaaagtgctgggattacaggtgtgcgccactgtgcctcctttaatagctatttactgtggactctttagctgtttacagaattgttttggacattatatgaacatgtttatgagcacttactttactaatcaaggggaatatagtatttagatggtgaggcaggataaaggcataaaaagataaataatcatagaggataacatttattaagtgtcagatgctaaaggagattagaagagggaatagttatggagagctgttttggaggctgccatggaagaaagggattacataagctgagagaaggctgaggataaccttgactttccccaactgtaaaatggagatattacttgccccataaggctgttgtaaggattcagtgaaataaaatatctaaagtgtctaaaataaatgtagtgctttgtgactatgtgatgtaactgctactactggtttttgttttttggactgaatataagtggttctttctgtcatctttaaaatttttctctcccagatgcctgacaacttggagatgacatatagttttcatcttaaataccaactgactacctgggacataatgttgaaaagattctcagactctacctggttttagtagggaagaatgctatgatcaattactggtgacaaggcacatataaaataggctggaggcaggaaatggttgtgtatgggttgctggagtaacagtatgtaaactgtgtttattatctttactttaagtcctagtatgtcttatttgtttctagccttccttttactacatcctgtaaaactttctaatataagatggcaagttttagaagtgagataccaagtttatatctgtactcagtgaattagccccggagtagaaaagaatctgatgtatcacccctgctccaaaatatcccttatgcattctttcccatttatattctagtgagctaatagtttctgtttaaaaaatacttagattttctgaaaagctgaagttctcaatgtgatctacttgagccagatgattttcctaatgcagtctgtccacatgagaaaatgagagttttgattgtggaaaggatgaattggaaaagaggggcatttttttaaaactgaaaaatagattggattaaaggaaagatatgcctgaatggctttcagcttttagatggtaggatgcctgagatgggcatagtagggttccaagatggtacaaaagagaaaagtatgctgaagataaatggaattttaatattaagagtaatagaagccataacattacaaaaacatgattttcttcatagtcttattttctgctcctttctcaaattttctgcttcctccctcatttccacttttagatacagcattattttattgccttttggttgtccaggttgatggctcaagttttgagttttgacccattccactttctagtctttacttaccttctctctttaaacccctcttcttttcttctaggtaaataggtagagcattgtaaacctctcgtggtactagtattttctggtggaaccactttgtctcacacagccacctaaagttcttctgagagaacaattatgcatgtgactccttttcttgcgtctgatttctcattagaaaggaccttggtttcagaaaggaaggactagagaagtagctggtgagaagtgaaattgtaaaatttgtactggatgccctttcctttctgaacattcttgtatctttgcatgtcttttcttcaagatacgaatacaggtttattttttataaaactttaaaaataaatattttttcttttactttaccctgtgtttgaatattatttaaaatttataaaatgaggttgtatattcttgattatactctctgtccccattttaagaaatggatttaatgcttctagttaaatgatttcaagtgataatgttgttttagacatatattcctgaaccatggtgttcagctacatttcaaactctttatttttggagccagggaacagagtagaaagtacaaaggtttctaaggcttattgctaataccaagtacatggtgacatctactacatagttgattcacgaacaatggaattcctataaaaagaagatctgattctagatcagagttatccctggaacatgtaaagatgtcaactttaataggaagatgtaaagcagctgttcttgtgcctatttcctttttacctagctctttagtttgatgtggtcacagtggcatttattctagtttaacaattaatttataatataaaagcagtccctagatttgtttgaaaccaactggttacatacaaaagattaattaaattcacacctattagaaaagatagaactttgttgtaatagagtgagaaggatgcagcattgtggcaactgaaatagtttgacttacagtaagaatcttttatgcttcagtgcatgagctctcatgaaaatatgaggaggtaggaaataatgatctgtatcatgataagttcagctaataatggcctcttcaaaaagctattattcacagggcagtggattccaaagtttctttgttaactttcacttgttagtacgttgtaagtttttctattaagtttatgtggaggagttgctgtacacatttttaaaaaataaaattctaaggcaaagaaacttatttgtacctgtaatcatgagttgttgtgtagagtctttcttaattaactaaaaaatatggcttcagactatgccaacatttcatttctggtaattttttgtttttctccgagacggagtctcgcactgtcacccaggctggagtgcagtggtgtgatcttggctcacggcaacctctgcctcctgggttcacaccactctcctgcctcacctcccgagtagctgggactataggcgctcaccaccacacccagctaattttttgtatttttagtagagacggggtttcaccatgttggccaggatggtctcaatctcctgacctcgtgatccacctgccttggcctctcaaagtgctgggattacaggcgtgagccactgcacctggcccatttctggtaatttttataattaaagcaaaatgcttttaggcaattttaattttgtttactgatacataagaaaagataactattttagttgcctcaatgctgcatccttctcactttattacaacaaagttctatcttttctaatatctttgcttatgacattctttttaatgtatatgctatacatttttatttcaatgtgcttttttctttgttaaattttccgtatcatccttctgcaggggccatgctaatcttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgagaacatgcggtgtttggtgtttttgttcctgtgttagtttgctgagaatgatggtttccagctttatccatgtccctacaaaggacatgaactcatcctttttatggctgcatagtattctgtggtgtatattctttatccagtccatcattgatgggcatttgggttggttccaagtctttgctattgtcaatagtgctgcaataaatatccatgtgcatgtgtctttatagtagaatgatttataatcctttgggtatatacccagtaatgggattgctggatcaaatggtacaccaacagtgtaaaaacatttctatgtctccacatcctcttcagcatctgctgtttcctgactttttaatgatcgccattctaactcacatgagatgctatctcattgtggttttgatttgcatttctttaatgaccagtgatgatgagcattttttcatatatttgttggctacataaatatcttcttttgagaagtgtctgttcatatccttcacccactttttgatggggttgtttttttcttgtaaatttgtttaagttccttgtacattctgtttattagacctttgtcagatggatagattgcaaaaattttctaccattctgtaggttgcctgttcactctgatgatagttttcttttgctgtgtagaagctctttagtttaattagatcccatttgtcaattttggctttggttgccattgcttttggtgttttagtcatgaagtctttgcccatgcctatgtcctgaatggtattgcctaggttttttctagggcttttatggttttaggtcttatatttaagtcttcaatccatcttgagttaatttttgtataaggtgtaaggaaggggtctagtttcagttttatgcatatggctagccagttttcccaacactgtttattaaatagggaatccttttcctattgcctgtttgtgtcaggtttgtcaagggtcagatggtcgtagatgtgtggtgttatttctcaggcctctgttctgttccattggtccatatatctgttttggtaccagtatcgtgctgttttggttactgtagccttgtagtatagtttgaagtcaggtagcatgatgcctccagctttgttctttttgcttaggattgtcttggctatgcaggctctttttttgttccatatgaaatataaagtagttttttctaattctatgaagaaagtcaatggtagcttgatgggaatagcattcaatctataaattactttgggcagtatggccattttcacaatattgaatgttcctatccatgaacacagaatatttttccatttgtttgtgtcctctcatttccttgaacagtggtttgtagttctccttgaagaggtccttcacgtcccttgtaagttgtattcctgggtattttatgttctttatagcaattatgaatgggagttcactcatgatttggctctctgtttgtctgttattggtgtataggaatgcttgtgatttttgcacattaattttatatcctgagactttcctgaagttgcttatcagcttaaggagtttttggactcagacaatgggggttttttaaataaacaatcatgtcatctgcagagacaatttgacttcctctcttcctatttgaatacactttatttctttctcttgcttgattgccgtggccagaacttccaatactgtgttgagtaggagtggtgagagagggcatccttgtcttgtgctggttttcaaagggaatgcttccagcttttgcccattcagtgtgatattggctatggatttgtcataaatcgcttttattattttgagatacgttccatcaatacctagtttattgagtgattttagcataaagggctgttgaattttgttgaaggtcttttctgcatctattgagataatcatgtggtttttgtcattggttctgtttatgtgatggcttacgtttattgatttgtgtatgttgaaccagccttgcatcccagggatgaagccaacttgatcgtggtggataagcttttcgatgtgctgctggatttggtgtgacagcattttattgaggattttcacatcgatgttcatcagggatgtaggcctaaaatttcctctttttttgttgtgtctttgccaggttttggtaccaggctgatgctggcctcataaaatgaattagggaggagtccctcttttctgttgtttgtaatagtttcagaaggaatggtagcagctcctctttgtacctctggtagagttcgtctgtgaatctgtctggtcctgggcttttttggttgttaggctattaattactgccttaatttcagaacttgttattggtctattcaggtattagtttagtcttgggagggtgtatgtgtccgggaatttatgcatttcttctagattttctagttgatttgcgtagaggtgtttatagtattctctgatggtattctgtatttctgtgggttcagtggtgatatccctttcatcatttttcattgtgtctatttgattcctctctcttttcttctttattagtctgcctagtggtctacccattttgttaatcttttcaaaaaaaccagctcctggattcattgattttttgaagggtttttcgtgtctatctctttcagttcttctctgatcttagttatttcttgtcttctgctagcttttgaatttgtttgctcttgcttctctagttcttttaattgtgatgttaaggtgtctattttagatctttccagctttctgatgtgggcatttagtgctataaatttccctctaaacactgctttagttgtgtcccagagattctggtacattgtatctttgaactcattggtttcaaagaactgatttatttctgtcttaatttcattatttacccagtagtagtcattcaggagcaggtttttcagtttccacgtagttgtgcagttttgattgagtttcttaatcctgagttctaacttgattgcaccatggtgtgagagagagactgtttgttatgatttccattattttgcatttggcaaggagtgttttactgccaattatgtggtcagttttagaataagtgtgatgtggtgctaagaagaatgtgtattctcttgatttggggtggagagttctgtagatgtctattaggtctgtttggtccagagctgagttcaagtcctgaatctccttgttaattttctgtcttgttgatctgtctagtattgacagtggggtgttaaagtctcccactattactgtgggggagtctaagtctctttgtaggtctctaagaactagctttgtgaatccgggtgctcctgtattgggtgcatatatatttaagataatgcttcttgttgcattgatccatttactattatgtaatgctcttatttgtcttttttgatctttgttggtttaaagtctgttttatcagagactaggattgtaccctggtttttttttctttccatttgcctggtaaatattcctccatccctttattttgagcctatgtgtgtctttgcatgagatgggtctcctgaatacagtacactgatgggtcttgactctttatccaatttgccagtctgtgtcttttaattggggcatttagcccatttatatttaagatatatatatatatatatatatatatatatatataattttattttattttttttgagacggaatctccctttgtctcccaggctggagtgcagtggtgcaatctcagctcactgcaacctccgcctcccgggttcaaacaattcttctgctacagcctcctgagtagctgggactgcaggtatgcaccaccatgcctggctaatttttatattcttagtagagacagggtttgaccatattggtcaggctggtctcaaactcatgaccttgtgatctgctcgcctcggcctcccaaagtgctgggattacaggcatgagccaccgtgcccggccaaggttaatattgttatgtgtgaatttgatcataatgctagctggttatttttcacattagttgatgcggtttcttcatagtgtcattggtctttatattttggtatgtttttgcagtggctggtactggtttttcctttccatatttagtgcttccttcaggagctcttgtacagcaggcctggtggtgacagaatccctcagcttttgcttgtctctaaaggtttttatttctccttcacttatgaagcttagtttggccgtatatgaaattctgggttgaaaattcttttctttaagaatgttgaatgttggcccctactctcttctggcttgtagggtttctgtagagagatctactgttagtctgatgggcttccctttgtaggtaatctgacctttctctctggctgcccttaatattttttccttcatttcaaccttggtgaatctgatgattatgtgtcttggggttactcttctcgaggattatcttagtagtgtttgtatttcctgaatttgaatgttggcctgtcttgctagattggggaagttctcctggatgatatcctgaagagtgttttccagctcggttacattctcctcatcactttcaggtacaccaatcaatcgtaggtttggtcttttcacatagtcccatatttcttggaggctttgtcctttccttatcattcttttttctgtaatcttgtcttcaagctttatttcattaagttgatcttcaatctctgatatcctttcttccgcttgatcaattcgactattgatacttgtgtatgcttcatgaagttctcgtgctgtgtttttcagcaccatcaggtcatttatcttcttctctaaactggttattctagttagcccttcctgtaaccttttatcaaggttcttagcttccttccattgggttagaacatgctcctttagctcaaaggagtttgttattattacccaccttctgcctacttctgtcaattcgtcatactcttctctgttcagttttgtgcacttgttggagaggagttgtgattacttggaggagaagaggcattctggtttttggaattttctgcatttttgcgctgggttttcctcatctttgtggatttatctacctttgatctttgatgctgatgacctttggataggttttttgcatgggcgtgctttttgttaatgttgatgttattgctttctgtttgttagttttccttctaacagtcaggctcctcttctgcaggtctgctggagtttgctggaggtccactccagaccctgtttgcctgggtatcaccagcagaggctgcagaacagcaaagattgctgcctgttccttcctctggaagcttcgtcctagaggggcacccaccagatgccagctggagctgtcctgtatgaggtgtctgtcaactcctgctgggaggtgtctcccagtcacgaggcacaggtgtcagggacccacttgaggaggcagtctgtctcttagcagagcttgaatgcagtgctaggataggagatcccctgctctcttcagagtcggcaggcaggaatgtttaagtcagctgaagctgcatccacagctgcgccttcctccaggtgctctgtcccagggagatgggggttttatctttacgtccctgactggggctgctgcctttctttcagagattccctgcccagtgaggaggaatctagagaggcagtctgcccatagctgctttgctgcactgtggtgggtttcacccagtctgaacttcctggtggcttccttaatacggtgaggggaaaaccacctactctagcctcagtattggttgacgcccctctccgtgccaagctctattgtcccaggttgacttcagactgccgtgctggcagcaagaatttcaagccagtggatcttagcttgccgggctctgtaggggtgggactcactaagaccacttggctccctgggttcagccccttttcaggggagtgaacggttctgtcacactggggttccaggtgccattggggtatgaaaaaacactcctgcagctagctcagtgtctgcccaagcagctgcccagttttgtgcttgaaacccagggcgctggtggtgtaggcacttgagggaatctcctggtctgcaggttgcaaaaaccgtaggaaaagcctagtagctgagccggatggcacagtccctcagggcttcccttggctaagggagggaggtccccagccccttgcacttcccagatgaggtgacaccccacgctgcttctgcctaccctcagtgggctgccctttccctctaaccagttccggtgagatgaactgtgtatctcagttggaaatgcagaaatatcctgccttctgcattggtctcgctgggagctgcagaccagaactgttcctatttgcccatcttgccctgctccttatttattaaattttaaaatgattttatttattttatttttagagttggggtctcactatgttactcaggctggactcaaactcctgggctcaattgactctcgaacttcagcctcctgagtagccaagactacaggcatgcaccactgtgcctggctttatttttatttttaattgacacataattgcatatatttatgggacacaatttgatgtgtcagtatatgtattgcattgtatcataattaaatcagggtaatgagcagattaatcacttcaaacattatttccttgttgtgggaacatttaaaatattgtaagctattttgagatacacaataccttattgttaatgcatgtagtatttgaatttctgtgtctggtttatttcacttaatgtcctccaggcttatttatgtttgtgaaaatgacagaatttccttccttttctttgcttttttttttttaaacttttattttatgtttgtgagtacatatgaaggtttgttacttagctaaacacatgtcacaggggtttgttgtacatatttcatttcccagatattaaacctagtactcaatagttatattttttcctctcttcctcctccgattttcccgtcaagtagaccccactgtctgttgtttccttctttgtgtccctaagttcttatcatttagttcccacttgtaagtgagaacacgtggtatttgggtttctgttcctgcattagtttgctaaggataatggcctccagctctatccatcttcctgcaaaagacatgatcttggtttttttttttgtttttttttttttacggctgcctagtattccatggtgtatatgtaccacattttctttaaccagtctgtcattgatgggtatttaagttgatttaatgtctttggtattgtgaatagtgctgcagtgaacatttgtgtgcatgtgtctttatggtacaatgatttatattcctctgggtatatgcccagtaatgggattgctgggttgcatggtaattctgtgtttagctctttgaggaattgccatatgctttccagaatggttgagctaatttacacctccatcaccagtgtgtaggtgttgccttttccccgtaacattgccaacatctgttattttttgatattttaataatagccattctgactggtgtgagttggtatctcattgtggtctttatttgcatttctctcatgatcagtgatattgatctttttttcatatgtgttttggctgcatgtatgtcttcttttgagaagtgtcttttcatgtcctttgcccacttttaatggggttgtttttctcttctaaatttaacttccttatagaggcttgatatcggacctttgtcagatgtatggtttacacatattttctaccattttataggttgtctgtttactctgttgatagttccttttgctgtgcagaatctcttaagtttaattagatcccacttgtcaatttttgcttttgttgtgattgcttttgctttctttgtcatgaaatctttgcccattcctatgtccaggatggtaatacctaggttgtcttccaggatttttatagttttggcttttacatttaagtctttaatccatcttgagttgatttttgtatatggtgtaagaaaggggtccagcttcaatttctacttatgactagccagttatcccagcaccatttatggaatagagaatcctttccccattgcttgtttttgtcagctttattgaagatcagatggttgtagttgtgtggccttatttctgggctctttattctgttccattggtccatgtgcctgtttttgtaccagtaccatgctgttttggttacggtagccctgtagtgtagtttgaagttgggtaccatgattcctccagctttgtttttcttgctttggattaccttggctgtttgggctattttttggttgcttatgaattttaaaatagttttttctagttctgtgaagaatgtcattggtagattgataggaatagcattgaatctgtaaattgccttggggagtatagccattttaatgttattgattcttcctatccatgtgcatgggatgtttctccatttatttgtctcatctctgtgttctttgagcagtgttttgtaattctcattgtagagatttttcacctccctagttagttagatttcattctttttaatggatgaatagtattctattgtgtctatataccaaattttctttatacgttcatctaatgttggacatttaggttgatttcatatcttgactattgcgaatagtgctgcagtaaacataggagtgcagatatctctttgacatactgatatcacattaagcaaatattagcagaccaaattcagcattctataaaacaactgcattataattaaattgggtttaatccaggaaagcaagtttgtttccaaattaggaaaaatctcttagtgtaactcaccgttttagcagatcaaaggtgaaaaagcatgtgatagttcagattctttaatctgtattcatatggtaattgaagaaaatggccaaaaatattgccaaccgtgatagcgaaaggttataattggatgctttggaaagaattgagaaaatcacatagaagaaaaatagtgctttcaaattaggtatggggagattgagctagttagtttagccagaaattaaagaaggaaactataaacatacactcattgagtattcctttaatgaaggaccacggctttttctttgagtagggattcaatgaatggaatatggcagaggatttcttatataatccatgcatatatgctttacacagttttcagtctcagtctcttgacaagaggggaaaaaccctgaagaacatatcttgaaatctgaaaacaggatactcctaggttttatgactttgtcctagactttttgcccaatacttgtccaaatcatatttgttatggtagagaagtaggatatgaaagcaagagtgagtgggaaggtgattgcatagatagtttgataaaacaaattatattttattgtaatcatttgttgactatataaaggatttttttacttcactataagcaatagattgcttttctctacagattaatgcaatttttcatctcagatttcaaaattgagtttttctacttttgtggatttttatactttttaagctaagtaaaggaacaaataagtagtaacactccagtgtaggaaggactgattagatatgtgtgtgtgtgtgtgtgtgtgtgtgtgtgtgtgcatgcaaatatacacatacatgtatgcacatattagattagcatatatataatttatatgtttatgtatctttgtatatgaataaaattggacaaaattagttattgaggctattttttagaaacattttaaaattgtagttgagttgttttattgaggttatttattttttttgagacagagtcttgttctgtcacccagctggagtgcagtggcacaatgtgggctcactgcaacgtctgcctcccaggtccaagcgattctttcatgttagcctcctgaatagctgggactataggcgtgcaccaccatgcccagctaatttttgtatttttagtagagacagcattttaccatgttggccaggctggtctagaactcctgacctcaagtaatccacccaccttggcctcccactgtgcctggtattgaggctgttttttagaaacatatttaaaattgtatttgaagtatttcttaatacaattatgtcccaactatttatcaatgttgtgtctattggaaatagtatgcttggtataatgtttaaactgttgcaaattgagttatatttagttgaaagttaaattgcacaatatgagtagcctatttgtatttccagtttggtattctttgatcctggaaggatggacgggcaaaggggagatgttagtcaagtagtgcgaagtttcagttagacagggggaataagttctagtgatctgttgcgcagcatggtgactattgttaacaatcattttttgtatatttcaacattgttaaaagagtagactttaaatgtttttactgcaaagaaagaatatgtgaggtgatgtggaatgctaattagcatggtttattatttatttacttattattattctactacaatgtagacatgtatcataacattacgttgtaccccgtaaacatatgcaatttttgttaattaaaaaaatttttaaaaagatgaaaaaaaaacccaattcagaatgtttatgtgttgtgttttattgttctaaaagagaggattttttttttttccaggcaacctaatgaggcctctcttgaattatggtattgcttggtgagcatatatatatttttaatgttacttttcagaataatgttgattaatttatacaaattagttgtatttttatgttactgttgcagtatgtctatgggctttctggttgaagaaagtgaaccagtagtttggagaggccttatggtaatgtcggccattgagaaattgttgaggcaggtaagaatattgctttaaatatcattttatcattggcaaagctgtggttaatacatttgctgattggagaattgttaaaatttgcattcaggaatcagttgatgggatgaatgtataatgcgtaatatggcacctaatgagttaatgtgatgccaagaccaaacttcactgttaacatgatttaatctttcccattgcttgtgagtactaaaaattctattgtcttacttaatactgttttcttgctttgactgtgtctgcagtaagaagaccaaatcaatttttataagttatcttccttctttagatttgtgattaatctcattgtggtcaatattgagttataagggcagtgtagaaattctacagatgtagaaaaaaattatataaaccaatgtacttgtgatttaaaattgctccagaaaaaagtaaaattttgttttgagtatatatggttatatatttgcatgtgtaatatctgtccaatcaactttaatttagccttaagaaaagaagagaacatttgattggataatctaaaaatatcaattgggctatatgttatttatagttagcttggaataagttttatttttttctcagtagatttgagtttgtaattgtcttctaggtaaaagttaaaagtaatttgcatttacttcatcaacttataacagttaccttttatttgttcagattctactttgggtcaggcaccatgcaataggttgataattctaatggtagatactcctatattcattttcaggtatacaattaagtagatgaaatctgtcttgaactctgaaactcttctttttttcactataacatcttgcctttctaccacttttgctgcttgaattgtgataaatgtgctgtttgatttttggtcctagtcatttaagtctcttggtttcattttctcctcttttactgtcagatcccctagttagtgatttcatttaaaatccccaaaccaccccatccccaccaattcctttgtgaccttgacctttatttgtcttgattaacccaccctctgttttctgtacttctaaatactatcagagaatatagaatagttgtgttaattgcctgcattatatatttttgatttttgaatttagctaccttcacaacacttcagtcatcagattttacatgttgttattctcaaaaaatattcagggaatttggtagtctagcagaggtccaaatgaagatttggcaaaaacaagctctctgacacataaattgtataaaagttacagtttattggttaggtgtggtggctcacgcctgtaatcccagcactttgggaggccgagatgggcggatcacgaggtcaggagatcgagaccatcctggctaacacggtgaaaccccatctctactaaaaatacaaaaaaattagccctgcttggtggcgggtgcctgtagtcccagctactcgggaggctgaggcaggagaatggcgtgaacccgggaggcggagcttgcagtgagccgagatcgtgccactgcactccagcctgggtgacagagtaagactccgtctcaaaaaaaaaaaaaaagttacagtttattttgagaagtatggtggatacattttcagcaaacatactatagaatatcaggataaagatggggtaagaaaatggattcatattttattgggatgctttgaggttacctagagtatatctatcttacagtctttcgtgaagtcactttcatgtgtgcattttattgggagctgaaaagctggtattttaggcctacactgggactaatgctgatcatcagagctaaggagtgttttcacttttgttttgatttagaaaccaaaccattatttggtaaatttaacatccttaatgaaaattcagtagctagatagaacttttgtacctgattcattggctcattttaaacaattgaatataacatatatacagaagaatgtacaaatcatgagtataattagataaattatcccaaagttgaaacacctatataatcatcatttagaacaagataactagaacaaaaccagtgatccagaacatcctctcatgttccctcctagtacccatttatggggagaagaaaaatactgtggtcattctgatatcctgaactagaagtctggtttaaagttgttttgtttttttctttttctccctgacaatactttgttgagctaaaattatgcatacaatgagatgcatagattttcagtatataattcagtgatttttgataaatatatatacctatgtaatcataacccaatcaaactaaatagcatttccatcctccaagagagtttccttgggtccccttctgtttcatcccatacccatagacaatcattgtgatttctgtcaccgtagtgagttttacatgtttttaaatttcaaatgaataggattatacaggatgtagctttttttttttttgagacagagtttagctcttgttgcccagtctggagtgcaatagtgccatctcagctcactgcaacctccgcctcccaggtttaagcaattctcctgcctcagccttctgagtagctgggactacaaggcatgcgccaccacgcctggctaattttgtatttttagtagggacggggtttctccatgttggttaggctggtcttgaactcccaacttcaggtgatctgcccgtctcggtctcccaaagtgctgggattacaggcgtgagccactgcaaccgtccaggatgtagctttttttttatatggtttcacttagcctaaggcttttgaaattcatgtttattgttgcatataatagtagttgggtcttctttattgctaagtaggattccattgtatgaatataataaaatgttttttttttctgttgatgaatatttgggtggtctccagttttgggctattgtgaataatacctctataatacttttacagttgttcagaagttttccagttgcttcacatttgtgttaacatttggtgttgtcagtctcgttacttttaaccattctaatagatataaaatgtatcttgttatggttttaatttgtgtttccctgatgatcaataatattgagcccttttccacatgtgtattagatctcatattttcttttgtgacgtgtctgttcaagtcttctactcattttttattttttattttttatttttatttatttattttttagtaattgagttgtaggaatttgtacgtattttggccatgagtccattgtcaggtaatagatattgggagtatttatcccagtctgtggcttgtctttttatgctggagtttgaattttaatgaattccaatttcttatcttttttatgcttagtgctttttgtatcctctttaagaaatctttgcctgtttaccccaaggttataatgataagaatgtatttatttttttttcttttttaaaattcttaatttaaaaattttatgggtatatagtagattagtatatttatggggtacatgagatattttgatacagacaggcactgagtaataattgcatcagagtaaatggggtgttcatcccctcaagcatttatcctttgtgtttcaaacaatcgaattatactcttttagctattttaaaatgtaccatcaaattattttttactataactacagtcaccgtgttgtgctagcaaatattaggttttattcattctttctgtttgtttgtacccatcagccatccccattccctccacccccaccacccttcacatcctcaggtaaccatctttctatgctctatctccatgagttcggttgttttaatttttaggtaccacagataagtgagaacatgtgatgtttatctttctatgtctggcttatttcagatatttgagaggacttgagtgttgtgatctaagttgtatctgctttagggggcaccccaaacctagtaatgcttggttcttgcagacgtgcagaggtactgccttgatggtcttggacaagatgtgggtgaattctctggattaccattcagaggctcttgttctcttcccttactttctcccaaacaaacagaatctctctctgtctgttctgagctacctaaagctggggatagggtgacacaagcacccctgtgtcctctaccactgtgactgcactagtcagacctgaagcctgcacagcactgggtcttgtcctgctgttaccactatccggctactgactatgtttgctcaaggccctgtagctgtacgatcagcaggtggcaaagcgagacaggcttgtgtcctttcctcagggcagtgagttctcccagaccccaggtgggtccagagatgccatctgggagccacagactggagtcagaaaccttagaagtctacctggtgttctgttatactgctgctgagttggcagtcaaagcatgaggtgcagttcttcccattctttcctcttctttccacaggcagaggagcctcactctgtggccaccagcactacagacccacagggcatacttctaggcttccactgatgttcacttaaggccccagggctcttcagtcagctcgtggtgaaggttgtcaggcctgagactcactcttcagggcagtgggctcccctctggcccagagcaggtccagaaatgccatccaagagccaagggacctaggaccccacatggtgctccaccccactgtggctgagctggcacctaaggtgccaggcaaagtctcctttacttttccctttgcttttatcaagtagatgaagtctgtcattgtagctaccacagcagggaatgtgctgtatcttaccttaagccagcacatctcagagtctcacccaaaggaccgtggcatagttcccgggcattgctgctggttgttcatggcccagaggccctttattcagcaggtgttggtcctgccatgactggatccttctcttcaaggtatcgggttaccttctggcccagggtgtgtctaggaatgtcgtccatgagcctggagtggggtcctcacaggtctgctctgtgccctgtcctactgtggctaagctggtatccaagatgcaagacaaagttctctttgttcttccctctcctgtcctgaagtgaagaaagggtctcttgtgaagccacgacctgtgcagcctggggttgggggagtgttggtgcatgcactccattagctgccctggctggtgtcttagtaggttgtgtgcttccctggtccactggctctgagcacagctcagctctaggactcgcctaggagctgcagtccttgtagcctagactccctttgaagtttatttagaatcccagagcactccagctcgtggtgttgaggcttgctggaactcaggttccgacctctgggatgagcgattcccctctggttagggccagtccatatgcttcctctgtgtgcaggcatcaggtaggtgcagcctggttctgctttttgctatgatggggcagcacaaagttcagtgcaaagtctcacagttgctgcattctccctccccaagcacacagattctctgtgccacacagctcttgggtgatggggaagggtggagaccacaattcaagactgtctttcctgaccttttcagtgtgtctttcagtaatataaaattgaaaccaggtattctgagtgctcatctgatttttggttcttatgtaggttttgtgtatgtgtgtagagagttgttaaatttggtgttcctgcgttgggggcggggggcaatttttttgcagccttctattccaccatcttgctttgctgtctctctcttatgttctcaaagctttatagttctgtcttgtacatcttgaattaatttttatgtgtgaaataagggtcaatgtttataattttttatagtttatacagttatgttagcatcatttgtttgaaagacttccctttccctgaatttatttatatattagataaaaatcaattaaccgtatgtgtatcatctattctggatatgcagttgtgctccattgatctgtttgtttaatccttactgtaaaaccacattgtcttgattattatagctttatagaaggcttaaaattaggaaatgtgcattttccaactgtgttttttcaattgttttggctgctctagtttcttttacttttctatgtattttagattcaatttgtgcagaaaagcatgttgatacttttattaggatgatattcaatatatagaacaattttggatgaattgagattctgacaacattgagtcttctaatctgtgaccttttcctacattttgttagagattctttaatttcttggagtaatgttttatagtttttagcatataggtcttcttttgttagatatatcttttatgtaatttatattttttgatcatcttgtaaattgaattgttatttaagtattgaatttcaaattgtttgttgctagtgtacagaaacatatactactgatttttgtacattaaccttgaatcctgtgactttgctaaattttaataatctagtagttgtttagtaactgtattagtgtcttgtgtgtacatttatgttgtctgcaaataaaacagcttaatttcttccttttcaatccattccttaaatttgattttctggtattcttattgcccttacttactgccagtataatgttgaacacagaattagaagagacatcctggcctttatcctgattttggtggggaagaacattaagtattttgttgctatgaaagatgatagctgtatcatgccctctctcaggttaggaagttccttcctgtttccttgtttcttgaaagtttttattgttaatcataaatgttgaattttttcaaatgcttttcccttaccacttattgaaatgatcatataatttttctcctttattctttttaatttggttatttattctcactgattttctgatgttaatgttttcttgatcatattttaattacaatgagtaatattgtaattatagttgtccctcaatatctgtgggggattggttccaggaactctataggtaccaaaatccatgaaggctcaagtctcttacataaagtggtgaatgtggtattcgcatacaatctacactcagcctccctttaaataattgctgtattacttataataactaatacggtgtaaatagttattatactgaattgtttagagaataatgacaagataagtctgtacatattcagtacagatgtaaccatccaattttttttctgaatatttttgatctgcagttggttgaattcatgaatgtggaacccgtggatatggtgggccaactgtacttttactgcattgctggattgaatttgctagtgcagatattttgttagacttttgcaatagtgtttgtgaataatattggtttgtaatttatttttcttgtaatatttttttcaagtgttatatgagagttagcctggcctcaaaaagtaagttggaaagtactttcctcttctgttttgtgaaatatcttgtgtaaaaaatttattagctttggtttaaatgttggtatttgaaggaatttatcggtgaaacccaggcttggcgtgctttgttttgttttgggttggtagaacatttttgatgactaattctattcagattttaaattttatcttgttttaattatgttaaattgtgttttataggaatttgtttcttttactttaattgtataatgtacacatgaaatttgttcataatattttcttatgtttttaaatggatatgggatgtagcagtgttccctccttatttctaatgttagtaatttgtttatttttctcttttattcttgattgttcttgccagatgtttataaactttactggttttttttttcaaaaaaaccgacttttcacccttagacgtttttctgtcatatgtttgtttcttatttcattgtttctgcttttatcattattatttccttcctttcatttgtatcaggctaatatacccttctttttctagctcttaaggtaggcagttaaataattgatttaaatttttttttaaatacaagcagttaaggctataaatttatctcttaggcgttgcttaaactttcacaaattctgatacgttggtgttttcattgtcattcagttaaaagtagtttctaatttccttcttttgcctacaaatatttttggtatgttgtttaatatctgaacattggaagatcttcttaataacttaatggcattgatttctagtgtaattttgttttggctagagaatacactctgtaatatttcagtgttaaaatgttttgagattttctttttgtggaccagcaccagcatgcgatccatctttgtgaatatttcatacgcttttggaacgactgcatttttaaattattttggttaatgttctttaaatatgatttaggtcaggttggttgacagagttcacatttttttgtaactttattgatttgtctagttactgtataaattaatgagagaggagtgttaacatctccaggtatgattgtatatttgcccatttctctctctatttcaatttttacttaatatattttggagttctgttatactctcatatgttttgaattgttatgtattcgtggtgaatttgcccttttgttgttatgaaatactcctctatatctctggtaaattcttcatattgaagtctactttatctgatactaatatagccacatttgcttttcttatgcatataatttcatggaatgttttaattcttttacttttaaccttctatttcattatatttaaagtgagtctcttgatttcaacatttagttgtatcttactgttttatccagtttgataatctttgccttttaattggaatgcttagtttatttacatttagtataattattaatggttgggtttcagtctaccattttgattttttcctcatatgtttcatctgtttttttcttttttcttacgttctttgaataaatgaaatatttcttgaattccatttaaattctccattaggtccttagctatctatccctcttggtattattattctatgactgctttagggattataatatgttttcttatcacagccttcttaaagaaaagttaatattgtgctatttaatatgtagttaagaatgctgtgtctcagtccatttagtgttgctataaaggaatacctgaggctgggtaatttataaagaaaagaggtttatttggctcatggttctacagactgtacaagaagcatggcaccaacatctgcttctggtgaaggtttcaggctgctcccactcatggtggaaggcaaaggagagccagtatatgcagagatcacctgacaagagagaggaagtgaggcggggaggaggtgctaggttcctttttttttttttttttgacaacgagctcttgtagaaactaatagagtgagaactctcattactttaaggatggcaccaagctgtttatgagggatcctcttccatgacccaagaacctcccactagattccacctccaacattggagatacaatttcaacatgaggtttagagagacatctatccaaactatagcaccctgtaacaatacagtaccattcaccatctcctatattttattgtgatatattttaactatacatccattataaatctcacatacagtgctataaaacttatttaatcatcttttaagctagttaataaaacaatctttttttttttttttttttttttgtgagacagggtctcactctgtcactatgctgtagctcaatggcataatctaggctcactgcaacttccgcctccttggttcaagcagttctcctgcctcagcctcccaagtagctgggattacaggccaccacatccagctaatttttgtatttttagtagagacggagtttcaccattttggctaggatggtctcgatctcctgacctcgtgatctgcccgcctcagccccccaaagtgctgggattacaggcgtgagccaccgcgcccggctgccaaaacaatcttttttatttacctacacacttgctatttcagtacttttcaatttttctttagatctgagtttaatctggtactgtttttctttatcttaaaaatcttcattttttttctatgttgtgggtctgctggtgatgaattttctcagtttttatttattggaaatgtctttatttttccctccttattttcactgcatatagaattttgagttgacattttaaattcaagtcttaaatgatgttccactgtcctctggccttcaactgctactaccatagtagtagtttctttagttgttctgtgagtaaggtggttttttctctggcagttttcataatttccttgatatctttgggtcatttttcttgcctatcccttaaatattgatgctttccagaattacatccatagctcaatagctaagggcatggactcagaagtcacatctgcctgagtttattccattttcaatatctaatagctgtgtgaccttgggcagaaacttctctgagcttttgttttctcatctgtaaatggggttgatggtagttacctcatcatggggattaaatgagttaatatgtgtcatatgcttaggaaacctagtgtcatgtacatgggttttgtaattattttattttgtctgggtatacttttttttcacattttaacttatcttcaattaagatgtattttgcaattgatggcttttcagcattgctttatccctgtattgaagtggggtcctttcagaaaggttttgtatcgtttttgcagtcacctggaatgctttaacctgaggcactttcaatttaattatccgttagaagttttggggaccactctggtggtatgaatacagatcggaaagctgcatgtataccaactggtggttcatgttgttaaggaggtgttttctcccctctgccatggcccaagttgagagatttctttctaaattgtggatttatatattatttatctttggtttaagatgatgtagtcctttgggatcctagctttatgtaggattctcctattagaccccaatttatcttaggtgtttttttcgtttagtgctacacaaaataatgatgcatcttataattagtggtgtattagatttgttgatgttataatgggtatcaacattgttaccagcattatccctgagacacctcttctgtcatggcttgaattaatgttgattatagtaagggaaagtaatgaattgaggacttctctttggttaacattcatatttggaggtgtgtgatttagtgggaggaaaaggagttagtaaacaggaaaagaagtagttcaaaaggtaggaaaaaactaaggatactaatgtcatgaagattaaaggtttggagcaatggttttccaacatatctgtatattagaatcatctagggattttaaacaattttcaaatttcagctcacacctcagaccaattaaattacaaatcctgggcatgtgacccaggcattatcacttttggaactgtccacctgattccagtctgtggacaagtttgggaatcactggtgtggagagttttaagaatgataggtcagggagaacaaggattgagatagggcaagggaataatagatgttcggtggaaatttgtaaaccttaactagaacagggaatgaaaaaagattataggggtttaagaatacatttataacaatactatgtaggtagaggtgtattctacctatatagagagtattgtattctaaaataggccattcaagaatttgggggctgggtgagggaaaggaaaggaaaataggatggtagcttaaggaggagtggtatattaaattaaagcctttttttttcttaaagaggacagccataccttttacaaggtgaaaggattcagtgaagaggcagtgaaaattatagaaaatgagaggattgttttaaaaaattatgaaaaaggcaaaagggaataggattaaaggtcagagaggtaagttatttttgaaaaagaagttcttccaaatttgtgtttggaatagaaaaaaagggcagataaagtaatcccatcctacctgacactaaaaagaagttaacaaaaggtattcttcccagtagacgggaaaagatggtgcatttattcaatagagcagtgatgcacagtttttagtgttcatgaaaattacatggagaactgatttaaaattcaaatttataggctttctattccactctcccacttgaagatttttattcagtaggtcccaggtatggccaaggaattcacattttaattagattattccaggtgactctaatgctggtgggtctaaaatcaggcttaggcatacaatggtacagaggcagttctttttaactgctttcagaggaattaaaaaaaagagagatgaggagatgaatgataagacccctgtgtagcagcaaaggcctactggatgctgaatatcaaaatttttacttttgccaagtttttatgactgttttcaataactctttgaagcctgcaaggtgacatgggtaaaccttttgttagatctaggattagtaactggtgtggcagaaagtccaaaggagaaaaatatccagggaattaatgagtggaacactgaagtcctggtttcaagaaagacaggtagtcaagagggatcaggagactgggtaaaattggagagatcaaatatgaaacacctggaatgaggaagaagcaattcagtagctggtagaagaaaaggtgtgaaaagtgatggataagttggttgtgttcagaggagggatattagaaacttaggcttttctaaaaaataaaagaatttggaaatgaggttatgtgaggaaaatcaggtctctagcaaagcaataaaaatgtcaaggatcaaagtatcacacactgggagcagggttgccaggtaatatgttggatgcccagttaagtttgagcatcagacacgcaatgaataatttgggatctgccttttctccatatcctcgccagcatttgctattgcttttcataacaacatggaatgcttcacaaatttatgtgtcatccttgtgcaggggccatgctaattttccctgtatcatttcaattttagtatatgtgctgctgaagtgagcacttgggatctgtccatactaaaatattattcagtatggctgggcactgtggctcacacctgtaatcccagtgctttggaagaccaaggtaggaagatcacttgaggccaggcgtttgagaccaacacgtgcgacatcgcaagactctatctctacaaaaaataaaaaacagctgggcatggttgcatgtaccagtagtcttgctatttgggaggctgagatgggaggactggttgagcctaggaatttgagattgaagtgagctgtgatcatgctgctgcactccagcctgggcaacagagtgagaccctgtttcaaaaaaaaaattcattgtgtatctcatattcaggcataaatgactttgagtttcctgtataactgtgtttgaactgtttgagtccacttatatgaggatttttttcagttaaccacattggaaaattttttgcagatttggaacaacttgaaaaaacttgcagatgaaccatgtatcttagaaatatcaaaaaattaataaaacatcacatatgtcatgaatgcctaaaatatatgttgatactagtgtattttatcatgtactacctaaagtatacacaaatctattataaaagttaaaatttatcaaaacttatgcatacaaaacttacacactgtgcatggtgccattagcagtcaagagaaatgtaaacaaatgtacagatgtagtactacgttataactgcataaaattcactgtactacatactatactgctgtgataattttgttagctacctcctgttgctattgtggtgagctcaagtgttgtgagtatccacttaaaatgctgtgtgctaatgatctctgcgtgagcagttcatttctccaatcaattattacagtaaaaagttatgtcttagagttttcatgtatttttcattgtgtttaacataataccgtgaaccttgaataacaccatgggaccatgtgaagtgccactagtgatgctggaagtctctgaagaagtagaggaaaatcacaacattacaaaaaaaagttgaattgcttgatatgtaccatagaatgaagtctgcagctgcagttgcttgccatttcaagataaatgaatccaacctaaggaccattgtgagaaaagataagaaaatttgtgaagttgttgctgcagctacattatcaggcatgaaaaccttgcacattttgccaaatacctttttactttgtattgaaaatgcagcttatatatgagtgcaggattgctatagtaaagcatgcctgtagactctaatattattcaagaaaaaaatgaagtcattatataacaacttaaagcaaaagatagctgaagaatctaaaggtggagaatttaatgccagcaaagtatggtttgataattttaggaagaggtttcccttaaaaaaatatcaatgtaacaggagaggcagtttctgccagccaagaggcagcagatgagttcgtggacatcattaagtaaatcactgggccaggcgcggtggttcacgcctgtaatcccagcactttggcaggccgaagtgggcagatcatgaagtcaggagtttgagaccagcctggccaacatagcaaaaccccgtctctactaaaaatacaaaaagttagccaggcgtggtggtgggcgcctgtaatcccagctactcgggtggctgaggcaggagaatcgctcgaacctagaaggccgaggaggttgcagtgagctgagattgcgccattgcactccagcccgggcaacagtgtgagactccatctcaaagaaaaaaaagaaaaaaaaaaaaaaaagaaaatctttgaggagaaaggctatctgcctgaacaggtttttgttgttgtttttttttttttttaacttttaggttcaggggttcagataagggtttgttatataggtaaactcatttcaggggggtttgttgtacagattatttcatcacccaggtactaagcctagtacccaataattatttttcttttcctctccctcctcccgccctccaccctcaagtaggccccagtgtctgttgttcctctctttgtgtccatgtgttctcatcatttagctcctacttaaaagtgaaaacacgtggtatttggttttctgttccggcattaggttgctaaggatagtggcctacagctccatccatgttcctgcaagagacctgatctcattttttttttttgtggctgcattgtattccatggtgtatatgtaccatcttttctttattcagtctaccattgataggcatttaggttgattccgtgcctttgctattgtgaatagtgctgcagggaacatacaagtgcatgtgtctttatggtagaatgatttatattctttagggtatatacccagtaatgggattgttgggttgaatggtagttttgtttagctctttgaagaatcaccatactgctttccacaatggttgagctaatttacactcccatcaacagtgtatatataagtgttcccttttccccccacccttgccagcatcagttattttttgacattttaataatagccattctgactggtgtgagatactgtctcattgtggttttgatttgcatttccttaatgatcagtgatgttgagcttttattcatatgcttgttggctacacatatgtcttcttttgataagtgttcatgtcctttgcccactttttaatggagtttttttttcttgtaaatttgtttaagttccttacagatgctggatattagacctttgtcagatgcatagtttgtgaatattttctctcattctgtaggttgtctgtctagtctgttgatagtttcttttgctgtgcagaagcttttaagtttaattagatccgcctgtcaatttttgcttttgttgcgattgctgttgacatcttcgtcatgaaatctttgccattcctatgtccaggatggtattgcctaggttatcttccagggttttgatagttctgggttttacatttaagtctttaatccatcttgagttgatttttacatatcatataaagaagggatccagtctgaatcttctgcatatggctagccagttatctcagcaccacttattgaatagggagtcctttccccattgttttttttttttgtcagcattgttaaagatcagatggttgtaggtgtgtggccttatttctgggctctctattctgtttcattggtctatgtgtctatttttgtaccagtgccatgccttgaacaggtttttaatgcaggtggaattgactcattctggaaaaaaaaaatgccacagaggacacttattagtaaggaagagaagtgagcaccaggatttaagacaggaagggctaggctaaccctattattttgtgccagtgcagttaggtttatgatcagggctgcccttatctataaagctgctaacctctgagcctcaaaaggaaaagataaacaccagctgccagtctttgggttggacaacaataaaatttagtgataaccccttttctggattgggtccactgacgtgttttccttgaagtcaggaagtaccttaccaataaggtactgcctttcaaaattctttcgatattggacaatgcccctggccacccagaaccatatgagttcgacatgaaaggtgctgaactggtcttcttgccctcaaacacaacatctttaatgtatcctctagatcagggggttgtgaggacctttaaggctcattatgcaggatactctatggaaaggattgtcagtgctatggaagagaaccctggtagagaaaaaatcatgaaaaagctgttaaagctatcaagcccaaaagaaattcctgctggagaaaagctgtgtccaaatgttgttcatgacttcacggaatttatgacagagtcaatcaggaaaatcatgaaagagattgtggatatggcataaaagatgagggatgaagggtttcagatatgcacctcagagaaattcaagaccttgtagacgccacaccagaggaattaacaggagacaacttgttggagatgagtgcttctgaaccagtgccagacgatgaggaagaattagtagaagaaactgtgccaggaaacaaattgacattagacaacatggcataaggattttgattattcaagactgcttttggcttttatgacatggacacttctatgatgcgggcactgaaactaaagcaaacagaggaagaaggattggtaccatatggaaacatttttagagaaaaaaaaatcagaaattacgatgtatttccatacactaatactgagccccctaagtacttctcatgggaagagccaaagaagtttgtcactgccacccctaagacagcaagaccattcccacctcttcctccttttcctcagcctactcaatgtgaagatcacgaggatgaagacttttctggtgatccacttccacttaatgaatagtaaatatattttctcttccttaataacattttcttttctctagcttactttattgtaagaatacagaatatactataacacaaaatatgtggtaatgactgactatgctattggtaaggcttctgatcaacagcagggtattagtaaagttttttgggagtcaaaagttatatgcatatttttgactgtgaggggatcagtatttctaagctctgtgttgttcaaaggtcaattgtactattatttgctaaatctggtaaccctagatggaagtgatgtttcttaaaaaagacaggaaggtgggtaatagtcaggttgggagaaggcagacataatgatgcagtggagctgaattgcttgagaataagagtttgaggtaatattaagggaatatgtttagcccagagtggcaggctcgtgagtagtggaaatgaggcgaacattagagtaggaggtggggtgaagaattataccaggacggggcagtcttgccaggattgttccttgtaatttcattaaggaagatggtttgtcaatgcctttaccaacctctgcagcttcttctgaaggataacttattttttaggatacatgaagtctcttggtttcaactggccactgtttggtaatctgcataatttcaccatatgtccttctaacctcatctgctagaaggaagggaaaagattgatggataaatatggtgtatgttcatgaatgcattttgtgatgccttgggaaaaaagcatgtcaggatatatatatttttttaaagttaactttaggatctattaggaaaaataggcagatatatgctaggatgttattttgagtattagatttatcagtatgtgttgctttttattctcttgatatttgaaacaatttccttttattttctattttgactttaataattataggtgtaaacatctaatacatttcactcaatgaataactgataatttaaaatttttctgttgttaagattcctgattagtattttttttcctcctgaattgtgctcctgaacatagatataattagtttaatgcaaatgagaaaagtcttttcttagaatctttgtgttttaaactatgtgatattgaaaaaaccaactttagttattagaaaaaagccacagaaagaaaaacttcaaaggctactgtgatgtcagcacctgctgtggtcatagtgtaaaccctggagaccagggattttggcagcagttttagtgcttttagttcaatcttcagtatccccaaatgtgaagcagatgccagttttcttctctaggcttctgataatggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaacatattttaaaatctataacccatttgatttcaaacagtattctgtattagaaattattattatacccaatgattttaaaggctcttaaaatagttcactttaaggtgaattgtgaaacaattcagtgtttaaatattagtagttgtaaggcatccataattgactgaatcatatctaaatccttctaatttgaaagtagtaatagatctggatatattcagcctcttaagatatatggaggcatgagaaaaatacttcagacgaccttctttgtagtcattcatagtttaaatagtttctaaggaaatgatccatttttcttcctttgacattataaaactaatataagttaccatcctcatccacctcatccaaatttatggtatgatatattaagttatgcctaagtgtcagagagataaaatattaaattatgttcttaagatattaagttagccatatctaaatataccaaagaaatttattaccttgcatggaaaagattcatagactatgcattaactataggtgaagtcattgaatattgttattgtcagtttggggcatgtgaccttattaatttctttttatgatttttgcatcatcaggtactctagcaggcctcatattttaaaaatgctttaaacattaaggaatgaggaacattaattaattcagttttcagttggacagggcggtagccttttaggcacctaagacaaaattaaaaaaaaaaaaaaaaaaaaaaacctttaaacatgaggtagattttcttttcttttcttttttttttttttttgagacggagtctcgctctgttgcccaggctggagtgcagtggcgtgatctgggctcactgtaagctccgcctcctgggttcacaccattctcctgcctcagcctcctgagtggctgggattacaggcacccgccaccatgcctggctaattttttgtatttttagtagagacagggtttcaccgtgttagccagggtggtcttgatctcctgacctcgtgatctgcccacctcggcctcccagagtgctgggattacaggcgtgagccaccgtgcctggccaacatgaggtagactttctatataatatagttcagttattgtttttagatttatttgggagcttaatgtgaagctaaggaatcaggtacattaatcctgattttgaattctcctttccattttaaaattatagattagtgaacaaggaaatagatacataactaaagtccagttctttgaaacatttgtataaggcagtattatttggtgagtagcttagtttgattaatctaacagaagttctttttgggcattttttcactcatttagtaattatttattgagctgacagcagatacttattgctgtactttaaaaatgtcattgggctttttgtcatcttacagcaacatacatacatacatacatttatttatttatgatggagtattgctctgtcgcccaggcaggagtgcagtggcgtgatctcagctcactgcaacctccgcctcctgggttcaagcgattctcctgcctcaacctcctgagtagctgggattacaggtgtgcgccatgacgtctggctaatttttgtatttttagtagagacggggtttcaccatgttggtcaggctggtctggaactcctgacctcatgatctgcccgcctcggcctttcaaagtgttgggattacaggcgtgagcctctgcacgcagccagcaacagacatttattggctatttactatgtttgggccattggttagatgttgaggttacacagttgtataagacatagatccagagttcaaaatgttaaataaagcctttagttacagatctacttttgacttgtaataataagcaagaaatatagatatgctagaagttttgatgatttaaaaaatactgttgtgcaatgttttatttaaggcaatcaaagttggaatttagagaacaaggctgagtgttacatagtgttgaccatcaggttggtaatagtgttacacagtataaaagtttgcagtctcatttaaggtccatgtcatagcgcaaaccctgttagtcagcattgaaagagaacaagttgttagaaggagttagaaacagcctatgaatattaattgctggttatttccttctacttaaaatgtccttctttttctgttgtcagatgacttacatgtgtacctacaactcactgtgatgatgagtacttatatatgcagtttttgagtattgtagtgttccttttttttttttttttaaatgttgctactggagctatctaagaccaaaaattactgcaactttttagattggcaccaactgttcccagtttcccactcactatggtttgggtgttggtcacctccaaatctcatgttgaaacttggtcctcaaccaggcagtgttgggaggtggggcctaatgacaggtgttggggtcgtgaagggctgagtcctcatgaatgaattaatgttatcatgggaatgggttagttattacaagagtgtattgttgtatagtgagcctggccgcttgtgctttctcttttgcattgcttactcgtcctttcttaatggaatcatgcagcacaaaggccctcacaagatgctggtatcttgaccttggacttcctagcctccagaaccatgaggtaaataaaactctattctttataaattacccagtctgtggtattcagttatagcaacagaaaacagactaaaacaccgcctgagtcatttgtgccaaatttctcaagtgctgtagtagatttggtcactgttattacttcactaatttacttttattttttggtttctagtaatgcaggtatagagacacttttcacttgataaaattacgtagtgatctgatgctttaaatgggtaattttatcaagaaagcaatataaataaagtaaccaaagtataaaataaggaggggagttactgttttaaagtatcagccactgatatttcactgcttgtgctgtgtagttttgaattgtagcaatttgaaaagctgggagggacctggctcttggagtatttttctaacccaacacccagggaagatctcctgctgcagccttctggttatatatagctgagctagattatattctgctctatattattgatcagtcttcttgggtcaactctagttctgtcatctttggaagaggaaggtactttactgttcttggccatgaattccttctttaggctttaggtcttgcagacacatcttgcactgttctggatgctagcatgtcatctcttgttctcccattcgttatatcactagctatttcctcacagtggctctctcctttgtcaaggttatgcttctttatctcgttacatggccttcttccttagaacttttcaatatggtattaacttcctcatccctgatcttgcccttaattcccagtttaaagtctttgtttactttggaaatgacttttcgcctgagtgaaaaaaaaacgtgttctcaacccatttgtagactaactcaggctctgaaaatgattgaagctgtgggctcaggttaccaattttactttcctgtcattgattcaaatgctccctaaagagagaggtagacctttccctgattctgtccattcatattaatttctcattctcactaagtgaacattagagaattagaaaccttcagaacatagaattgggggtataatttgactgtttaaatacaaacataaaagtttaacaacagatttcatttctgatttttctggcttctaactaaagaagtaaaaatataagagaaaaacggagtgtcttgtctaactccaggcctgaatctgaaaagagaacaggaaaggaagtaacaagaaagagaaaggacataaaggtactatgaaattgaagccatcattgtagtttaaatttgaccagtgtttcaaatataaagcaaagatgtttgggtcgtcttttgttctgaccagacagataaacttttctcatttccttctttgtgtatctaccagaggaaagtaatgaaatagaggtcctggaacagttcatgttaagggtaggctctaactgtagctctgacaaaagtaggaagcatgcagaaagctggcttgtttataagagataaaatggcacagtcttattcaattgaaagccaacaatcaaaattagagcaaaaggaagcactattagaaaaatgtgccaagccagtgaaatatattgatcaaaggggaatgaaagatatcagacacagtttattagcaacaaaaaatagtgaggctgaagtaatttgcttttgaaaataaataaattaaaaggaggctaattaccacctttacaatgtcctatttctaccttaaacacttccagaagcatgccttttttactctatctgttgttcaatgcagacttaaaattttgtgttaatcaatatttattctgcaatgccaaggtgacaaacaaaaatatgaaaaggctgttagggcttaacatttttgttgcagattaaatatacagcattgaaaactggaaaggcatgacttcatctctgaccagcagagttaaagagaaaaatctctccattttccatgatgcagactttgaagaataacctacagtgatttgaactgagttaggatgagggtaattataaaacataagagtcttgtcttctgcagtgataattaagaagccttaataaaggtcacatgagatgacttgctgagcctttaggagagcttcttagagtagtggcccctgttgaacaggtaaggacttaccctatctcttttggtgcagtcggggatcatgggatcagagtcagatgtcaaaagcctactggggctatttaagctccaggaagacttgaacagatcccaagcaggcgatgagaagagtaataaatattattggggacttccagtactggagattatgacctctttttactatttaggtatatactgtatttcattgactttaagttacgtatttttcaaattttaatatctctgaaattggagagtattttataatcagtaacatcttggcattgtgtcagtttaatatttagcattgttttctttcttggttgtatataaaataatggtgtatcttccaatctatggtgttttagatatgacgagatatagtcaatgttttccttataattattttaatactgattgaattgtattcccatctttgccgtcattgctgcagagcgattctacgtcattcattttggtctttttttttttttaagtgttgaaagactattttaaactgatggcggcagttttggtaacttgttttagtaacatcctcttttatgccctcatcactgactttattttccccccatcacttaccagagattgccagatgattcttcccaaagcataactctcatgtcagtaatttcagagaccatcagtgtctccttgctactttttaaagcaagctaccctctggctttattcattttttcagtagttagatgttagggatattgttataaataaaaaaggcacgaaacctgtcctatagattcttttggctactgcgaacatttacttactgattttttttaagccagtgctatgtgatcattcatagtttgaaaaaaatttctatactatttgccttcataggcatgtgtctgtgttcactacttatttttcgtattattattaatgtggtgttgatggaaagtccaccaaaagaagtgactcaatagtgacttacacttttttttttttttttaagacagagtctcgctttgtcacccaggctggagtgcagtggcacgatctcggctcactgcaacctccgcctcctgggttcaagcaattctcctgcctcagcctcccgagtagctgagactacaggcatgcaccaccatgcctggctaatttctgtatttttagtagagatggcatttcgccatgttggtcaggcttgtcttgaactcttgatctcaaggaatccacctgccttggcctcccaaagtgctgggattacaggcatgagccactgtgcctggcccataatgacttaaatatcttttaaaaatattttttgtttagggtaggcctatatgtctgtagcaacaaatatattagacttttatagttagtttattttggtagcatctaaatgtggtgtattaattatctgaatgcagaaagcatcaaattaaataggttgaattgatatattatccctagacaataatattttactaaaagtagctacctattattaggtatttattatctgctaagacttatactgtttatctgcattcacatttaaatcacacaattctatataatgtactattactattatttttacaaatgatgaaactgaggcacaatgaggttaaataacttgggcagggtcctacttgtaatctctctgattctcttggctcagcttttaactaaactgtacaactgaagttttaaaattttaaatttttgcttgaaagattgaaaacactctttttaatgtcatccctgaaacgctaattgacaaaatattaagagtattcttttgtttcccaagttctcattcagctacaagttttgtattttatacgttgtattttataagacatttctgagtgaatgtatctgtaaatatctttactctgaaatatatttttgtgaagtttatatggagacctgttataaagtctttttagtagtgtttggcaatgagaagtttgatactcttctatgttgtgatgtcaataactgcagtaatataattcatttattaagtatagtaactgtaggattagattttaaatgttcttaccataatgaaattttaaaatgttaagtatgtgaggtgatgagtatgttagttgcttgatttcatcattctgccatgtcagcatgtatccaaacatcacattgcaccacataaatatactgtgcagttattatttgtcaattaaaataaggtaaaacttaaaaattgaattaaaattgttatacagtattcattatttgggcttaattacatttcactgaggtacaatggcatttcccagttacccagaacaagttattattcagtaaagggaaataagtttctgtccagcgacacagtaaatgtctgtattatccagattaaaacccaacagctcttttcttagtggttaattgttgatacttctacactgttaagagggatttgtggaagcagatggccattagtagttcagtagactagttactcttcagtagtagtgagaggtgacagcgtgctggcagccctcgcttgctctcggtgccttctcggcctcagcgcctactctggccatgcttgaggagcccttcagcccactgctgcactgtgggagcccctctctgggctggccaaggctgcagccggctccctctgcttgcggggaggtgtggagggagaggtgtgggtgggaaccgaggttgcatgtggcccttgcaggccagcgcgagttccgggtgggcgcaggctcggcgggccctgcacttcgagcggccggccagtgccactggccccgggcagtgaggggcttagcacctgggccagcagctgtggagggtgcgctgggtcctccagcactgccggcctgcctgcactgcacttgaattcttgccgggcctcagccgcccctccacagggcagggctcaggacctgcagcctgccatgccccagccccctcccccccaccaccgtgggttccctcacggcctgagcctccccgacgggtgctgccccctgctccagggctcccggtcccatcgaccgcccaagggctgaggagtgcaggtgcgcggcgcgggactggcgggcagctccatctatggccccagcacaggatccactagacaaagccagctgggctcctgagccggctggggacttggagaacttttatgtctagctggaggattgtatgtgcaccagtcagcactctgtgtctagctcggggtttgtggatgcaccagtcagcactctgtatctagctaatctggtggggacttggagaacttttatgtctagctagaggattgtaaatgcaccagtcagcactctgtgtctagctgaaggtttgtaaatgcaccagtcagtgctctgtatctagctcatctagtggggacttggagaacttttatgtctagctagagaattgtaaatgcaccagtcagcactctgtgtctagctcagggatcgtaaacgcaccagtcagcaccctgtcaaaatggaccaatcagctgtctgtaaaatggaccaatcagcaggatgtgggtggggtcagataagggaataaaagcaggctgcccaagccagcagcggcaacccacttgggtccccttccgcatgtggaagctttgttctttcgctcttcgcaataaatcttgctgctgttcactctttgggtccgcgccgcctttatgagctgtaacactcactgcgaaggtctgcagcttcactcctgaagccagcgagaccacaaacccactggaaggaatgaacaactccaggtgtgccacctttaagagctgtaacactcactgtgaaggtctgtagcttcactcctgaagtcagcgagaccacgaacccaccagtaagaagaaactttggacacaccatctttaagaactttaacactcactgcgagggtccgcggcttcattcttgaagtcagtgagaccgagaacccaccaattccagacacaatagtttcacctaatgtcaagtattggattactttcaaatcatttttattccctgtgaacaaatagatttagagagaaccctttgcaatatgtgaatagtttaggtcaaataatggtgttaaagagcatagtccccatgagactgcccttacttttgacattgactgcaagtgtaggggttcccaagatcacccttaagttcaataatttgttagaaggactcaactcactgaaagatgttatactcacacttatagtttattacaggaaaagagtacatattaaaatcagccaagggaagaagtgcataaggtggagtctggggagttatcaaatgcagagcctctgttgtcttttcccctcagaatcagtctgttagtctcctggcattgatgtatgataatacgggtgtagcattgccaaccagggaagctcatgtgagccttgatgttcagagtttttattggggctccgtgataggggcatgattgattgtccatatggctgatctcattcttttgtctcctgtccctccagtcatgacccaaagcccccactctaaatcacattattactacatggctagctcaaggcccatgagcagagaccttagagattacatcctagaagctgaggtcaaagacaaattatcttggggccttttggggcaaggttaaattctttacagaaataatgtgaataatactggtttccaaaatgaatgtatgtgtaaagctaaatttggatattaacctagtagctatgacatactgcaactgaaactttctagtaattaaaactcagaattccttgaaagtacaattgactctgactataatattctccagccagagaggctactaggatggttttttaaaaaatactttgaggtctactaattctgttataccccacattcctgtcactcttggtaagtgcccaaatattagcctctctggtcattaaaaagaaaaaattttcatctttatgctgtttaggacttccattctcctaaacctaaacatttcttccttttcttccccaatttttgtttggtgcttctggtgcccaattttgtactacataaattctctttaatatctttaactaaaaactgtgattccctgcagacagtgcttttaatgaagtcttaagtagagcttgttttttgactcactgtctactagagatttagggtaagatttggcatattccttatttgctagggcagcttctactctaatacttatattcttatattctttttgcaggaggagaagtttgttaaaaagctttagagcaggaggaaagaaaggaaagtgcatttggaagagagccaagtgagcaacttgaagaataagtgccctgtttaaccatgatcctaggactttataaactggcatctcgtgcccctttctcgtgattcttcccttagggtgggctgcctgcatccatagtgcccttcttacccttgggaattgagcacacacagtgtgtttgggaaattgtacacatgcccatctgaggctttctttccttttctggtggagtgccccagtaaggtcataatccaccattttgcctcttaatgtgtgtattagtctgttttcacactgctgataaagatgtacctgagactggggagaaacttacagatccacatgcctggggaggcctcacaatcatggcagaaggcaaggaggagcaagttacctcttacatggatggccgcagacagagagcttgtgcagggaaactcccaattttaaaaccatcagatcttgtgagacttattcactgtcttgagaacagcatgggaaagacccactcccgtgattcagttatctcccactgggtctctcccacaacatatgggaattatgggagctacaagatgagatttgggcggggacacagagccaagccatatcaatttgcatgcctgggctcaatcgcccaatacctgagattttattggaagccttttttgcttctccttggtgcctgcatttaattaacactttaacagctgtggatcaacaggagattgtctctgcctggcacagctgccaaattatcatttttagagaagcagtatgataattgtccagccaccacctgacattcctactgggtcggcgagaagagccctctcctgccttgctcatgccggtctaactacctgtaacatttccctcctcaagagcccaagaccacaaatctttgaggaaaaatggatgaagatcagtcttctgtaactgctttctgctgacagaggggtggtgttggttctgtgagtattggcctcttgctagctctcagggcaggagggtgactctttgggtggtaaaagcagtatctatccaggtccaagggagacaggggcaggattttgccttcttcctgtcccactgatggacattctaggggtcccctttagaagcctgcctcttgggtattgagagaacagtatctctcactgaggatttttatacttatattctttctgatagtcatagttactgaaagtataattggccaggcatggtggcccacgcctgtaatcccagcacattgggaggccaaggtgggcagatcacctgaggtcgggagtttgagaccagcctgagcaacatggagagaccccgtctctactaaaaatacaaaattagccaggcatggtggtgcatgcctgtaatcccagctactcaggaggctgagacaggagaatcgcttgaacctgggaggcggaggttgctgtgagccaagatcatgccactgcactccagctctaggcaacaagagcaaaactccatcttaaaaaaaaaaaagtgtaatccttctctcattctcttctttgttcactttttttctcacttgttaaagatgttggcacttcctgttccctctagttctacccaccaccttggataacttcagagttcacatagacaataaactttaacatcccagtgtgtctggaattggtgggttcttggtctcgctgacttcaagaatgaagccgcggacccttgtgctgagtgttacagttcttaaagatggtatgtccggagtttgttccttcagatgttcagatgtgtccggagtttcttccttctggtgggtttgtggtctcgctgacttcaggagtgaaactgcagaccttcgcggtgagtgttacagctcttaaaggcagtgtgtctggagctgtttattccttccagtgggttcgtggtctcactggcctcaggagtgaagctgcagacctttgtggtgagtgttacagttcataaaggtggcgcgtccggagttgtttgttactctcatccggagttgttcgtccctcctggtgggttcatggtctcactgccttcaggagtgaagctgcagaccttcatggtgagtgttacagctcataaaggcggtgcagacccagagtgagcatcagcaagatttattgtgaagagtgaaagaacaaagcttccacagcgtggaaggggaaccgagcgggtcgccggctgctggctggggtggcctgcttttaatcccttatctagcctcacccacatcctactgattggtccattttacagagagctgattggtccattttatagagagctgattggtccgttttgacagagtgctgattggtgcatttacaaacctttggctagacacagagtgctgattggtgcatttacaatcctttagcaagacacaaaagttctccaagtcccctacccaattagctagacacagagtgctgattggtgcgtttacaaacctttagctagacacagagtgctgattggtgcatttacaaacctctagctagacacagagtgctgattggtgcatttacaaacctttagctagacagaaaaattctccaggtccccacctgacccagaagcccagacggcttcacctctcaatggcagtcgccgtgggactttgcaccacctagcccgggcactctggcagcccagaaggagcacatcccccgatcaagcccagcaggtgctggctggccatgcccagtgcagggcctgccgagcctgtgctcacctggaacccgcactggcctgcgagtgctgcacgaagccccagctcccacccgtgcctctccctccacacctccccacaagcagagggagtcagctctggtcttggccagccccaggtaggggcccccatagcgcatcggcaggctgaagggctcctcgagcacagccagagtggacaccgaggctgaggagatgccaagagtgagcaagggctgctagcacattgtcacctctcaatcccccctctaaacaggacaccccaactgctgttgggaatttggccgatgaccactctagctacttcctgctggataggggcaaagaaggggccctgcagttatagtgtcctccagaggggagctctttaggccagtggaagggccagcggatcggtccaggggtcctcggtagaagttgttagttgagctcatttggggttccatttgtaagatcatcagttgagcttgatggcctcaattctagaggaaacaaatttgacaagaaggttaaaaatacagggtccaaaggtgagtaacagcaagatggctgccatgggacctagaaaggggagaagccatgttgcccaactccagaggttggtataagagtttgaaaggcgttgtctgatttcagaagccttttcctgtaaatgccgggtggcatcttctactatcccttactggttagtgtaaaaacaacactcttcccctaagaaggtgcagagtcctcttttctcagcagcgaggaggtctaggccttggtggttttggagagtcactgctgccaaagagtctatttgggattgtagagtaaggatagatttcatcacttcctgcaaattgtctgagaaatcctttgagagtgtgtggcagtaggataatacatgttacactgttaatttttagtaaaccttactttagttgaaaaccttgtaagtttgggattttagtttttctttgctgttaataagacctcattcagtccatattaacttaaaattggtatagatggctccttcctgattctgtaagtactttaaggtttggctgagtgcaaacagctcacacgtttgaggagaccaattattaggcaattttcttaactctgcttctataagagtttcattttctcttagtgaatacccattgtgtctttttttccttaatcgcctgggaggaaccatctatcatcctgtcctgtagggagttcctcctagatctggtcggacctttgtatggtaattaagatttagatgtcctgttaggaaacctgctgggttaagaatttttgataggaaggctacggattgtcagtggcctcagtgctttcgggctatgcccttgtttacactgacaacaaggtggtattggattgttatagggttacagggaagaccttcaattatcaattgtgggttttaaatttaccctggcttttaaaggaatagggtacactgttttttctttactacttccatctctctttctttctctttgacttctcctttgtctctctctttctctctttctgactccctctttgtctgtctcttcctctctttgtacttctttctttgactttttgtctctctggttctctccttgattagagtatagaggggcctggctatctcgctgtgtccggggatccatagtcagcaaacgctgatgattccagggaacccttgcaactgttttaatgtcttagggtgaggataagccagtataggctgtatatgttccttgctgagggccctggtccctctagctaagattagacctagatatttgacctgctataggaaaagctgggccttcggcctaaacaccttgtacccttgattagctagaaagttcaagagatctagagtagcttgctggcacgaggcttctgaactggtagccaaaagtaaatcatccacgtactgaaggaccagagtgcctggacttgagaagtaacctagatcttgggccagtgcctgaccaaacagatgagggctatccttaaacccttggggcaagactgtccacataagttgggacatgtggtctgtgggatcctcaaaggcaaaaagaaactgggagtcagagtgcgggggaatacagaagaaggcatccttgaggtccagaacagtgaaccattctgcttcctctggtatttgagagagcaggatataggggttgggtacaactggatatagaggaattactgcctcattgatgagtctaagatcttggactagtctccactgactgtttggtttttgtactcctagaattgggctgttgcagggactgctgcatttctttactaaggcttgagcttttaaatatttaacaatatcctttaatcctttatgagcttcaggccttaagggatattgcctttgataaggaaaagtggtggggtcttttagcctgatttggactgggtgggcattttttgcttttccaaattgtccttccaatgcccagacttcagggtttattccctcttcaggtaggggacaacaaatgggtaacttgttccccatattcatgtagataatagctccagctttggctaatgtatccctctctaataagggtgtgggactttcaggcataacaagaaaggcatgtgaaaagagaaagtctcccaattacgactgaggagttgggagaaatacctggttacaggctgtcccaggattcctcagatggtaatggaccttgaggacagtcgtccaggacaggagattaacaatgagaaggctgcgccagtgtctaggaggaagtcaatttcctggccctcaatggttaaaggtacctggggctgagtgagggtgatgacatgagctggcgcttgttccgggcaccctcagtcctgttgttggatcatctggttgggggcctctgacccagagaacctttgttctctggggcagtgcaccttccagtgattgccttggcatagcagacatggacgagggggcggcttgtttctcattggacaatcttttttaaagtgtcctagtaaaccacactgataagccctaccgggtgattggcctgctccattttctgtcctctctgaaccaccaaggtttgtttgtctgagggccatgactaaggctgcggtctttctctgatcttgcttttccttttgggcctgttcctcttggtccctgttatagaatactgaggttgccaggtttaataatgtctccaaattttgtttagggcccagggcttgcttttggaactttctcctgatatctgtggctgattgggtaataaacttatcttttagaatcaattgaccctcaagtgatttggttgacaggggagtatattttcttaaggcctcccatagccgctcgagggaggcagaaggattttcttcctttccctgagttatggtggacatcattgaataattcatgtactttttcctaattctccttagtccttctagaacacaggtcaacagatgtttgcaactgcagtccccatgatctgagtcaaggtcccagtggggatccatactggggacagcttgctgaccgttagggattttgcccctttcttcagctgtcattctgtcatttacttgactaagataccaagtatctccaaactcttgggctgcagctaaagctgcattcttttcattaaaggccagggtttgatctaacaatagcatgacatctctccaaatgagatagaagatttgtcctagaccctgtaggacatttatgtacctatcaggatcatctgaaaaattccccaggtctgccttgatctgctttaaatcagagagggagaaggggacatgtacccaggttgggccaaattcccctccccctacagcttgaaggggacataaccgatagcccaggggtttttgttgtcctttggagatttcttcgcatatttccttctgggcaggggagattagaggaggattatcgttaataggacggggagctatagggaggctaggatatgggggtaagctgataggtcctcctgtgggatgtaaatggcaagctttgcatagttgtgtattctccttcaatgaaaagaaagcttggacataacttatttcactccatttgccttccctcttacagaaaaggtcaagctgcaggatagtattgtaatttgtacttccctcaggtggccatttttccccatcagagagagagtattggggtcaggctgtagcacagaaaaaaaatgtgtcacctctttttcagggtttatgggtcaaattggtcccaatggcttaggatgcatttcaagggtgagcctgttgatgcctgagtgtttcctatctgaatgacaaaaccgcccgcagatttggtttgtttgtttctccccctgcccaagaacctgcaatggtccctggaccctgctgattggaatagttgcactcaccgatgcagcagcagaaacaacccctgcccaagaacccacaacaatccctggaccctgctgatcggaatagttgcgctcaccaacgcagcagcagaaacactagcttttctcccagaccacaaggaggactaaggaaggtcggatttagtgacccttactgacgcattctcgaaaacctgcaccctttcctgtcctcctagaccacaaggaggacagagaaaaatcagatttagtggctgttacagacgcattctcgaaaacctgttagagtcctaaacattctcctgttagtactggaaccttacccgtgtcctataaagatgttatgcccccagaatgaagtggagggccataccctgatggagggaagggatctccagggttggaagagtgacaccttttgtcttcacttatatgaataggaaggatacaatttctgaggctccccatatcctagcttcaggaatagcttttgttaggcctgcttgtctgaggagggatcctaaaattccggatagttccccctacaatggggctttgggaaaaattatgtctttctgattggtgagcctgggtgcctaaagaaggaaatagagtcctggagtttatactagaaatcattcttataggagaaactagaaaagcaccagagacagggagtgatttttagaagcaggactaacctcggagaagagaggtgaggggaagtttgtctgacaggcattaggacccaggaggcaagggtcaggatagataggatagatgggtgagtctcgcttgggcgacatgcctttgagggttccgctcatggccacagggtcaaccaacttgttgttcggaccccggagctgaatggctttcctctctgtcgacccttggctcggcccagaagtacaggaaaagtggaagctggttctaggcaaaccaacgctcccaactccaaagagtcaggggatgttagagagccccttcccagaaagcctgacacccgtgtctttagtctggttgccgcgctagtagcttttaactggccgacaggtgcccggtatttagcccctgaattctaaggagaaacaggacagaatagcaagcaaaaggggtccagtggtactcaccgctcggcgataggtgatagtcttactgcttggcaataggcgatagtcttactgcttggcgataggtgatagtcccttcgtggttgcaaaaatgtgtctggaattggtgggttcttggtctcgcagacttcaagaatgaagccgcagaccctcacggtgagtgttacggttcttaaagatggtgtgtccagagtttggtccttcagatgttcagatgtgtccagagtttcttccttctggtgggtttttggtcttgctgacttcaggagtgaagttgcagaccttcgcggtgagtgttacagctcttaaaggcagtgcgtctggagttgttcattccttccggtgggttcatggtttcgctggcctcaggagtgaagctgaagaccttcgcggtgggtgttacagttcataaagatggcacatccggagttgtttgttcctcccgtctggagttgttcatccctcccagtgggttcgtggtctcgctggcttcaggagtgaagctgaagaccttcgcagtgagtgttagagctcgtaaaggtggtgcagacccaaagaatgagcatcagcaagatttattgtgaagagcaaaagaacaaagcttccacagcatggaaggggacccggagcgggttgctggctgctggctggggtggcctgcttttattcccttatctggccccacccacatcctactgattggtccattttacagagagctgattggtccgttttgacagagcactgattggtgcatttacaaacttttagctagacacagagcgctgattggtgcatttacaaacctttagctagacagaaaagttctccaggtcaccacccaacccagaagcccagatggcttcaccaatggtactcgccgcaggactttgcagcacctagccccggcactctggcagcccagagggagttcgtcccctgatcaagcccagcaggcactggctggttgcgcccagtgcggggcctgtggagccgtgcccacccagaacctgtgccagcctgtgagtgaggcacgcagccctggctcccacccatgcctctcccttcacacctccctgcgagcagagggagccagctccggcctcggccagccccagagaggggcccccacagcacagtggcgggctgaagcgctcctcgagtgcagccagagaggatgccgaggccaagggggcaccaagagtgagtgagggctggtagcatgttgtcacctctcaccagtgttaccaaaacatcaggggtttggtctgggtcctgtggctctctgcacagaaaaccagtcactgagagaatgagtattgccagggaagaaggctttaatcacgtgcagcagctgagacaatgggagatcagtctcaaatccatctccttgaccaactaaaattgggggtttattatagcagggaagaaatgtaattatgtgtgggaaaacaggaactagggaggggtaaggaagaggaactggttaacgagaagcaggtgaccacttaggaacataggaattagggaggggtaagggagcaacctgatggatgaagggtctgccatctcattgtctggatgtggtgatctggtgagtttcagttctttgatactttttgagaaggctgaggatcatttcctgagaaaggaacttaaataagacaaacgttagttttaagctttaagaccagaagggtcaatttctatatttattttaaaaaactactgggttggtttcactagcctttttagtttcttccctttctcaacttgagtgcccttgaactccactctcatggcacaccaggaattttatccccttgaagtattcatcttaattaccttaccatagtttttcgtctttgagttcttttattaaggccattatatgtcagattccttgactgtttcactctttctgtacctttcatttttttcctaacatgtttatatatggcacattatgtcactggcttgctgataatttcagctccttcgtatctttccctttcagttgtgccacaaacccattggtacattccttttactctaaacccataaactccagtttagaatggattcagcattcgactttctctattcttacgcttgggctgctgggtgctgctagagatgtccttttaagtggcatgtggatggcactatgaattaatgatttctagccttgctcaacaacccgtaggaaatttttcttctattttttttctctcttgcttagaaacctgttattctaggcagccctctcttttattctccgtaggaactatttaaaatctgctttgttattctgaagacctctgtccttctacctctccctttacttttaatgcatgattccattttctgtttcacaaagaaaattaaatttatatggtgcaaactttctcaattaccagccagcctccttaaaaatgtatctgtatctgaattcattcttgccctcttcccttctgtatctggttcttagtctttactaactcttttccatcagcatttaaacatgcatgtggaagacagtactgattggctatgtagaaactattcccagcccctgtctctttactgcttaaaagtaggtctagaaagtcaaaagataatctagttgctcttagagctgagtgtggccatgtgaaccagttctaaccaatgagacacaaggaacagtctgtggagatagcctctatgtaagatgttttgcttcctaatagaaaggcaggttttgttcttcctctttctttgtagggaatataaagacatgatcaacttggcagtggtagccattttgtggcagaacaagaagatagaaagaccaaagccttggcctttgatgatatctctgagactttgaaaaaaaaacaacaacttagtctttttgcatctctgtgaaggaatacctgaaactgggtaatttcttaagcaaagaggtttaactggctgatggttctgcagggcatacaaagaagcatggtgccagcatctgcttctggtgagggcctcaggaagcttacaatcgtggtggaaggcaaaggtggggagcaggcgcagcacatggtgacagcagaaggaagagagacaggcgggagaccccagattcttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaa

SEQ ID NO: 1343 - DNA, 146655 bp, Homo sapiens
cttctaaacaaccagatcttgcgtgaactaaccgagcgagaactcacttatcaccaagaggatggtgctgagccattcatgagggaactgctggcgtgatccactcacttcccatcaggcctcacttccaacattgggaatcacatttcagcatgagatttggaggggagaaacatccacaccataccacaaataaaaagtcccagagttgtctactttcagactttttaaaaaagtaaataataaatgccctaatagtttaagcattgttaggttttctgttacttgcagctgcagtcatcttaagttatgatgtataagtttttcccagttttaaaaaacaacaaacgagaaataagtaacactgccttgactctatgacttccactaaacaccagcctaaactttcttctcacttaagccaaactcttcgaaagaatttactaaatcagtctctcactccctcatctaccatatacttctgtttatattcagctctaccatgctttagtcagggttgggtcaccagagatgcctttaaaaattcctgtatatacttttcaattcttattttaaatgatctctttatactatttgatctactgatcgtaaagtttccctaatactacattctcttgtggcgtctaccttttatcctctctttctcattctgctttatagtttcccttttctctgctcatttcttaaatatcagtccttaacatgggtataattattccacttttataggcttagaaactaaataagctaaggtcatgtacagtcatgttttgcttaacaacatggatattttctgagaaatttgtccataggcaattttgtcattgtgcgaacatcatagagtgtacttccacaaacctagatagtatagcctaccacacacctaggctctatatggcatagcctattgctcctaggctacaaaattgaacagcatgttattgtactgaatactatagggaattgtaacacaatggtaaatatttgtgtatctgaacatacctaaacataggaaaggtacaataaaaatacagtgtaaaatatgaaaaatggtgcccctgtgtagggcacttaccatgcatggagcttgcaggactgaaagttgctgtgggtgagtcagtaagtgagtggtgagtgaatgtgattgcctagaacattgctgtacactactgtagactttataaacattgtacacttaggctacactaaatttatttaaaaaattttctttctctcaattataaatctgccttagcttactgtaactttattacttcataaactttttaagttgcaaaaaacgttttgactcataatatttataccacaaacacattatacatctgtacggaaatattttctttctttacatccttttttctgtaagctttttttttctgttaaaatttttttttcttttacttaaaaaattttttttggtcaaaaacttagacacagacactcatattaggctaggcctacatgggtcaggattagcagtatcattgtcttccacctccacatcttgtcccactgaaaggtcttcagggacagtaacatgcatgaagctgtcatttcctatgataacaatgccttcttctggaataccttttgaaggacctgcctgagtctgtttgacaggtaactttgttttcttaataagggaaggaatacactctatagtaatgataaaaagtatactgtagtaaataaaccagtgacatggtcctttattatcatcatcaccatcacccagtattatgtactgtacctaattgtatatgttacacttttatgtgactggcagtgcagtagatttgtttataccagcataaccacacttatgagtaatttgttgtgctatgatgttaagacagttatgactttacaacagctatgatgtcactaggcaataggaatttttcagcagctccattataatcttaagggaccattgcctatgtggcccattattgaccaaaatatccttctctgcacataactgtaattagtaaatggtgcagccaacatttgaacagagtctaaaacctctgcaattcatctctaggaaccttttctgattttgtgctcattctgggcaatgcctaatggaaagctctgcttgactgtcctatggatatctcaaagtcccaaagtccagattagaattcatcactcatctacctgaaagtcttccttcttttcttgtgacagagacttaatgattgacactaccaaccacctagctgctcaggctaaaatcctgagtgtcacccttgactcatccttctttctttcccactgtttgtacttatggtgttcatttctcccatctctgctgctatccttccctacaatgtccacccttttctgttttttgggaaagctgtaacagactctttacctatattcctatataatctgagatattctgactaatcttactaaaattcagatctcatcaagttactttcctgatttatacccttttgtggcaccttgttttttggacaaaagttcaaaatctaacctaggaaaaaggtccttctttatctaatcagggcacattttcccacttctactctctgttccagctgtcttaagcagtttgatattcctgaattcactttgctgtctcttgcttctgggccttccctcctgctttcctgtcttgctggaataccctgttcttaactaactccatcttatccttcatgtcttagcttagatgttactcctttgggaaagccttgtgtggtaacctctcacttcatattaagtgctcttgtgttctgcagcatgttgaaagggccacacattctcttgtctcagggcctttatacatgctgcttcctgtgccttcttttccctacctctacctggttgctattcattccagacagtgctctgtggtagacccacattttcccctatcatagcaagaaattcttctcttcactttgtgacatttcagacagtttttattgcattcctgtgttttagaaatttagaattttgaagcttgcttttaatttgtggctccttcactcttaatctaagccttaaaaagaaacaccactaccaaaacaaccccaagcctgttccttagctttatgcttctccaggcaagctgacattgcctaactcaagaatcgattttgtgtcagaagtcagctgatggtgtttgtttaaaaaaaaaaaatggtattttcagctttcggccccgactactgaacctgacaagttctgacatctcttctcttggctgcctctcacttttttttctgtttccatggaaatggacatcagatcacagaaacatagtaagatactagtggctaattgctgttgcagaattcaaaattctttttgtttgtggagtgattattttggtgactcttacccactgtgtagtatgtggtagttagccaaaacatctaaggcaatttatgggtttgagagctagaagatgctttccaagagtcactaactggtatcctaaaatatattctctttttttatctttcacggaaaacatattttaagaactataatcttgtcagagaagaacattagatttcaagccaggagatccagccctagtcccagatctgctgctatctcactgtttgacctctgtcaattttgttatatttattgaatgaacaattgctgctacttagacttggggctgtttacaagtgtcccagggaaaagactgtctttctgccagtgtgctttaatagcaaagatagaaataaaatatataactaatcttagttaagaaaatcaaacccaagtttctaaacatctaaatggaaaaatgcttttaatctcaggcctttattttttgccttctggaaaatgatcagaataagattctgtcatatggccagaaatgttggtgtaagattatatttttaatatacatgtggtttcttaagacaagtacagcctatcttacagcaaagtgattaaaattgtagtaaaaaaattctattaattttccatttagtgaggggagttattacattacttatataatttgtattttattcagatccaggatgtatgaggagttgccacagtcatatacctttgtgtcaggcttatctttactaggtcaggatttcttcataaatctaaatttagaacttggaaagccaggttttgttaagtgcaaaaagggactggcatgtacatataaaaaagattagtgtttgctgagctgcttcttcagcacgtagtgtctgctctatatcaaatgaacctgagtaattgaaattgagtatgaacagaataaatctcttttttgcatgactacacagaataaaatagagatgcatctcaatttatgatgaagttatgtctcgattaacccatcgttaagttgaaaatatcgtaagtcaaaaatgcatttaatacacctaacctaccaaaaatcacagcttagcctggcccacattaaacgtggtctgaacacatacattagcctacatttgggcaaaatgatatccaaaaagtgctggcaacacagcacactaaagaatatgtgttgtttaccctcatgactgaatagctgggaactgatttgttgctgccgccctgcatcgccagagagtgtcatactgcctgtatgtcaccagtccaggaaaagataaagattcaaaatttgaagtataatttctactgaatatgtattgctttcataccatcgtaaagccaaaaaatcataagttgagccattgtatgtgtgggacaatctgtataggtttatactgaactctcacttataattgcaagtatatagacataagtcatacaggttaagacattataaataaattaaatgggaaataatccattttatactttataattcagtcagacattcctaaaggaaaaaaaaaaaactaccttatttaatttgctgtgaatttagtctcccataaagaactgcactagacttggagtctggtcctgtcacttcccacagtttgtgagacagttgcaggcatcagtagattcaccataggccccagtgcttttaggtgcatagcattaaagcaaaagtttatttttgtaaataaaaaagtcttatacttgtggtataattagacaataagaaaaaaatattcaagaaagaaattataatggcccattaccccatgatcaaagtaagccactattaattttttggcatattctttcaattaaaaatatctaccagtgcatacaatgagatcatgataatgctatacatgctgctttttagccaacttacttcattatgccatgtcatgaacattttaccctgctattaatattcttttaaaaatgatttaaataatgatatagtatgccatcttgactgattttataatttatttaactcttaagagcttattggatatttagattgtttacttacatacaacattgagcaggagcctataaactttctttaatccctttagccaatgtggaaagtgcctagattatatgattttccaggctagtaccttattacttttactttgatttattctcatcgcccacttctcataattctgtaagtcccactaattttatctttgaaatcactcttaaatttgttcatctccattctcgctataattgcagtagttcaagtcttcgtcatctaacttggagtactgcaataataacgtgcatagctggtcttcctacctctggactcttctttcaatgtattactcatcttatggttaaaaattatctttctaaaacatggatatagtaatatatcctctggttttaaagtctttgatattttttcattgtctgtggcataaggcatttgcctggttttcaaggacattcgtattttggtcctgtctgtcccttttagcctcattattctcctctttccacattccacataggtagccttccctgaaaacactgaggtgttctcagagtcctttgtgtactttgtttcttttccattgcttagaacgtactacctctcacctcattggcttcttactttcttcttcaatgcttcagctcaaatattacctatcctttaaagctgtgctgtccaatacagtaactactagctatatgtggcttttaaattaaagtaaaataaagtaaaaaaaattcagttcatcagtcgtaagtatatttcacatgctcagtagtcacatgtggctagtggctattgtgttggacagtacagattaaagaaaatttttatcactgcagaaacttctattggacagcactgctataaagtcttttatcaaataattagtttcctccttaaagtttccataacccttacaatgaaccatttaaagagcccttgaattccttcatagtaagtgagggacaccaagcctttttctttttatcactagcacctagaatagtatgtggcatgtagttctatttcaagatgcgtttgttggctgatgaacaaataagtaaaaaatgactcaaattttggggagtcgtatgggttaatggcaatgttcggaggctttcaattctaaagtaatgctaatccccttttgtaaagtgtgtaactattagttttacttcattagtacaaagtcttaggcaaattgccctgtttctctgatgattttactatctaaatattggatatctaaatatctaaatactggggaattaagtatgtttgccttatagaatttaacataaggccaacatttactgagtgtgtgccagatattttagacatttcacaaaagtataaagcatttccagtagattccatgctattgccagagtttatattccatgaatggagagaacaaacgttgagctggcttagtatatggctgaaattttcactgcttttatttcattttcataataattttattatgtagggtaatttttttttctgtttttcagatgaggaaacagaagcatagaaaagctaagtagctttcataaggtcacatatagctgggaagggactctattacacctcaggtgcatctctagtaacgtttttttttttaaacttttattttaggttctgtggtacatgtgcaggtttgttatataggtgaactcatgtcccgggggtttgttgtacagattattttgtcacacaggtactaagcccagtacccaacagtttttttctctccctccccccattctccacctttaagtagaccccagtgtctgttgttcccctctttgtattcatgtgttctcatctcttagctccctcacttataagtgagaaaatgtggtatttggttttctgttcttgtgttagtttgctaaggataatggcctctagctccatccacgttcctgcaaaatacatgacctcattcttttttatggatgcatagtattccatggtgtatatgtaccacattttcttttttttcttttgagacagagtctcgttctgtcgcccaggctggagtgcagtggcacagtcttggctcactgcaagctccacctcctgggttcacgccattcttctgcctcagcctcccgagtagctgggactacaggtgcctgccaccatgcccagctaatatttttggtttttgttttttgttttttagtagagacgggttttcactgtgtttgccaggatggtctcaatctcctgaccttgtgatacacccaccttggcctcccaaagtgctgggattacaggcataagccaccacgcccggccatgtaccacattttatttattcaacctgtcattgaagcgcatttaggttgattccatgtctttgctattgtgaatagtattgtaatgaacacatgtgtgcatgtgtctttatggtagaaagattgatattactttgggtatatacccagtaatgggattgctgggtcaaatggtgcttctgtgtttagttctttgaggaatggccacacttctttccacaatggttgagcaaatttacactcccatcaacaatgtgtaagtgttcccttttctccgctacttcgccagtatctgttattttttgacattttaatgccattctgattggtgtgagatggtatctcattgtggttttgatttgcatttctctaacgatcagtgatgctgagcttgttttcatatgtttgttggctgcacatatgtcttcttttgaaaagtgtctgttcatgtcctttgcccaccttttaatggggttggttttttttcttataaatttgtttaagttccttatagatgctggaattagatctttgtcacatgcagagtttgtgaatattttctctcattctgtaggttgactgtttactctgaagatagtttttttttgtttttttctgtgcagaagcttttaagtttaattgcatccatttgtcaatttttgcttttgttgcaattgctgttggtgtctttgtcatgaaatctttgcttgttcctgtatccagaatggtattgcctaggttgtcttccaggatttttatagcttttgatattgcatttaattctttaatccatcttgaactgatttttgtatatggtgtaaggaaggggtccagtgtgaatcttctgcatatggccagccagttatcccagcactgtttattgaatagggagtcttttcctcattgcttgtttttgtcagcttgtcaaagaccagatggttgttggtgtgtggccttatttctgggttatttattctgttccattggtctatgcacctgtttttgtaccagtaccatgttgttttggttactgtagccctatagaatagtatgaagtcaggtagcatgaagcctctggatttgttctttttgcttaggattgccttggctattcaggttcttgtttggttccacatgaattttaaaatagttttttctagttctgtgaagaatgtaattggtagtttgataagactgccattgaatctgtaaattgctttgagcagtatgaccatttaaatgatattgattcttcctatccatccataagcatggaatgtatttccatttgtttgtgtcatctctgatttctttgagcagtgttttgtagttttcattgtagagatctttcacctccctggtttgctatacttgtaggctttattctttttgtgtcagttatgaatgagattgtgttcctgatttggctctcggtttgactgttgttgctgtataggaatgctagcaatttctgtacattggttttgtatcctgaaatgttgctgaagttgtttatcagcgtaagaacttttagaccgagactatagggttttctagatgtagaatcatgtggtctgcaaacagggatagtttgactacctcttgttccattgggatgccctttgtttctttctcattcctgattgctctggtcaggacttccaatactaagttgaataggagtggtgagagagggcatcgttgtgccagttttcaaggggaatgcttccagcttttgcccattcaatatgaggttgtctaggggtttctcacaaatggcttttattattttgagctctatataaccttatttgaattgtttaatacatttaatgccacttggtatctttagtgatattcttcaattgttcatggctagtgtatgtcttggcttttggatttaagagaaaccaacagcctgaaaaaaatttgaagaaggaaattataatgcctcactgttaacattttgtgatcaactgctaaggcctggtactgtgcttggttgggctaatgagatctaataaaatcactttaaaggaaaaaccgtaagttctatgaggagtggaattctcaaagccttttgaaggcattttattgattataattataatctcatgccactggctctttagcaggtttttaaaaatgtcctaaacctagcatcagtattataaagttccactgtacagtgcccagcatggaggtagtattcagtaatggtttgtttaatgaatttttgaaaaataagagacactgctattggtagttataatagctagcattgtttgaatgtgttctgtttgccaagaattttgctctgctttttacttgaattatttcattttgctcactaattgacaatttattgaacacctataatgtgttagttactatgctagggctggagatacagtgatgaaacaaagacctttgtcttgtggatcgtacattttggtggtagagacagaaacaaacagataaatgaaaaccgtatagtataacattgattaatgatccatgctttggaaaaaaaggcaagataagacaattgagaatgatcagggaaggcttatctgagaaggtgacatttaagcagagacttgaatggaaggaaagggagtgagccatccaggtatttggaggaagaacatacaaaatgaagggaacaagtgcacaagtgtcaagtgagcaaggaagccaggggttatgtcatctagtatcttatagtaaagattttgaactttattccaaatatgataaaagcaattggaagtttagggtagtaaaagggacatgatttggttgttttaaaaggattactttggtggcttgtgtagagaattgaactgagtgggattgaaaggtagaggttaggagaagaatgaaagtaggtagaccaattaagagtactcaaacaaccctgtgagataggttgtattattgtctccattttttggttaaaacacagagacagagaggtcaacaggcttgttcagtgctacaaatccagtttgttttgttaattgctatccattacttcatgggattgttgtgataactaaatgagatacaggctgagtatcttttatccaaaatgctgcgtaccagaagtgttttggatatcagattttttttggattttggaatactttcatatacataatgagataccttgaggatgggatccaagtctaaacatgaaatttacttatgtttcatatacactttatacacatagcctgaaggcaattttatacatttgaaataatttggtgcatgaaacaaatctttgactgcattgactgcaccccatcacatgaagtcagatgtggaattttccacttgtcgggtcatgtcactgctcaaaaaatttcagattttggaacattttagatttcagctttttttttttttttttttgacttgagtctcactctgttgcccaggctggagtggagtggtgcaatcttggctcactacaatctccacctcccgggtttaaacgattttcctgcctcagcctcccaagtagctgggattacaggcgcccaccaccacgcccagataatttttgtatttttagtagtgacggggtttcatcatgttggccaggatggtctcgaactcctgacctcaaatgatctgtctgcctcagcctcccaaagtcctgggattacaggtgtgagccaccgtgcctggtccgatttcagatttttgaattaaagatgtattttatctagaagtgtcaaacattgctttgtacataggagttggtaaatgttatggcctttctcataaaaataaatattgcaagtttgagaaggacagttcaagaaaatttatgtagcaattactaattaatggcctaaagtcatatagaacctggtatttgtactcctttccttccagtcttaaggattatgtcttataaagatctgtccaaagcaccgatagaattattttagcctttaggagacaaagttcagagatatttgatatagctgtcttaaagtataaagggctgtcatgtgaaacagggatttgttttttatgacccaagagagcagaaatctgatccaagggtgaaaactactgggaaggttattttggctcataaaaataaatatatttcaaaaatagaatgaatgctctatcagtggaactgtttgcatgttgctatatcatttttctggaatgtgtcaggcattcagggttttttgtttagtttgcagatttcttcaacctgagattcactaaaatataagctatatgaaagcagagatcttgtctgtctgggggaccacagtatcctcaatgtctagagagcaccatgcttgatacacttgttgactaaatgaataatgagttaattattctcacaggtcatctggatacttcattccttctctttgcctaaagttcagttctgatttttgattgatgacttgagtgtttatactgggttaaaaataagggaaactattgtgaattgctttctaggaagtcaaaggcatcactgcagggcttctcaacagtggcactatcaatgttttgagctgatgatgctttgtcttgaaggggctgtcctgtacattgtaggattttagcagcatctctggctgctaaatactcaacagatatcagtagcaacccccacccccacttaacagtcatagcaataaaaaatatcttcaggcgtcaccaaacgttcctttaggggcaaatcagctcttgttgagttagcgaataacccaccagaacacacccatgctaatagatgaatccaatattttcattagataaaattaaagaaaatagtgtcatttaaggaaagctcattgtaaattatttattttaagatgaactgtgcactagtatgagctgtgtgttgaggcatgcctgtagctttataatgaagaaattgtagaatgctcttacgtatttctaatttgttttgaaatatgatgaattcaagttgattatttagctttaggtcctcagtaatgaaggcttaccatatttctcttatattgttttttcagccccaaattaccttgacaaccattatatgttgaaatacagatgtggagagttcaaaaggaggggttggtggaattagtggtttgtaactgtcaaagacaaagacatcataaggtataacagcagaaaaggacagcagcagcagaaagctgagcaggtgatcaaagattctagaagcaggagacccaaggatttttttaaagttatgtatattttaaaatttatattttggtcttagtgtagaagtatgatcatctcatgatggatatggtttcataagcagttatggtatatgctaggcacattagaaataaattatttttgggccacacttagtttgtacgtcttgactccccttcctagtatttacattgatatttccttttgtttaaatccaaatagcaagttctaataaatccaaatagcaagttctaataaatccctgcttgtattatattttaattcagtatgttttcttgtcacatcacactttgtttgtaacatattttactaaactattcatggtcctgatttaagtataagctgggaactgttgcattttaatatacaacatttgcatatatattatgatgtagtcatttataaaatataatagtcttactgggcattattataaaagaagcatctgtcagcatttctattataaaatcaaaaaattttaaggagtttctgacttgtctgtttctaaattgctttggcataaaacctgtatagaagctgtcaactgaaatctaaattttgttatttatagaaggcagaattgaagctagttttttttactactttttatcactacattaaaaacattcatattttttcatagattcaggtgctttttacttgatatttatttatttcccataaacccaagtgaggaaatggaaactgagagccactcaaatgtacttatttattttcttgtgttgtattataaatttatttattattattattattgttaaaatagagacaagatctcgctacatttcccaagatggtctccatcctcctacctcagcttcccaaagtgctgggattacaggcgtgagctactgcacctggccatgtaaaatttttgatagatttatttgaaaagtatttaccaagtagacgcattaagtattttgttagaaccaccttgtaacatgatggtgtctgtataaagcctgtaggtagctagatccagacttagtgtgagtagagaaactcagttaatgactgcaaagtaatatcaatttagaagggtcaaagagaaataagaacccctactattgatcactagacaactattcactttctcaaccataagacctgtctctgcaatctcattatagctgatacttttacaagtgactaacttggttgattgctatcccttccagctttttgtgagatgtcattgctgttactgtagtaggtgattctttcaaattgcttttaaaaactcttgaaagccaaagttattatctaattttgaacctgagattggggatcttcttatgaaactgattatttatatagaaggttaacattagttactatagaacttcaaacaaaattgaaataattaaggagtttaagcacctgaaattgaaagagtttactcatttataattattcaacaagtacggctgggcacggtggctcacgcctgtaatcccagtgctttgggaggctgaggtgggcggatcacttgagttcaggagtttgagaccagcctggccaacatggagaaaccccttctctactaaaaatacaaaaattagctgggcgtgtggcaggcgcctgtaattccaatacttgggaggctgaggcaagagaatcacttgaacctgggaggcagaggttgcaatgagccaagattgcaccactgcactccagcctgggtgacagagagatgctccatcccccccccccccaaaaaaaaagtcattcaacaaatatgtatatcttaccccagacaccatatgcagaatatatgatgaacaaaatgggtgtggcccttagcattataggtgacatataagtaaacaaacatagaataaatagttcttatttattttggtcaagtttaatagtattccaaaggcttacccttttataaataatccacaatgcagaaacctacatttgaatgtacaaatttttaatgtttattggaatgtcaagattaaaacatattactttagtcatatgtaaactcttatttccacattaatagaatctttttgcctttatatgtattttgttattgcttttgcctaggaacttgatttttatgtatttttcttgtattcagccatcttaacactgttatttattctaatattaagttggtgtaaaagtaattgaagtttttgccatttttttaaaatggcaaaactacagttacttttgcaccagcctagtaacttttaaacagaattcctaagtaggtgatgttctctttgacagtgtttatatctcttaattgttttccttttcttattgcattatctagcatcatcagttgaattttgaataataacagtgatagtggtcatccttgtctcatatatgatattgatggcagtgtttctcctctttcactattaagagtgatgtatgctgtaggtttctagtagatcctttttattaagttaagggtgtttcctttattcccagtttacagagatttaatgattagaaaaagtaaggttctgttgatatcatggcagtacggcaatttggaccaatattcatgctaaggacaatttaaaaattggataaaatatgaaaaatagatttttacaattatttgggagaagatgagaacccataggaataagcatattctctcaaaatcacttttgttttaaggatgtttgttgatcatagcttaccagttttgaagctaagttctgccttcatatgcttcacaagactgaggggtgtaagtcaaaatctggagttggccaaggttgagaattctgcactgtagtttgcttgaaccacaaaaggctgagctttcagggtagcagtgaattaatgctaatttggctctcccagaaacttgcaagacaactttcatcatcatctgctggatcaagtaatcttttttttttttttttttgagatggagtcttgcaccgtcgcccaggctgtagtgcggtggcacaatctcagctcactgcaagctccgcctcctgggttcacgccattctcctgcctcagtctcccgagtagctgggattacaggtgcccaccactatgcctgactaatttttttttgtatttttactagagactgggtttcaccgtgttagccaggatggtctcgatctcctgacctcatgatccatccaccttggcctcccaaagtgctgggattacaggcacctggcctggatcaggtaatcttaaatctagaatttagattaagatggtcctggattgtagtttttccaagctgtagcagagacaaaagaaagttctctttggaagaggacgttgtcagccaatgtgtcagtttattttttttttaaacacattattcagtgcacaggcaaagataatcaggcatggaaggataaaagacactttgagtaaaacctagtagatacaacagacgatagaaatagactcagtgaaaatgatacactggaattgttagacatagactataaagcaactaaatttgctatgttcaaagaaataaggccaaaaataaaaatctagcaacaaactggaaactaaaaattatccagcagatatgaaagcagtaagataatagtaaaactgaaaaacacactatttaaaacttaatcattaggttgtacatgagattagatataggtgtaaagagaattagtgaactgggagataggtcagaataaacagttcacaatgcaatgtggaacgataaaaaggggagctccaaagaagatggtaagagatacagatattcagcgcaaagaaccagaaatccagagagccagcttgaattccaaattccatcattaccttatataatacatttgacacacataattttttatgcctctgggtttcagcatcacttcttagtgggcactgctgttaatgcagtttttacttatgtagcatagtccaaagattgcttaagttttctgctgtaacttctcattttttccatttaaccatttaatgaaaacatttactaagtatgtaatatttgccagatcctaagatagatgccaggaatggatacaaagaacagtttgttcattataaactcaaatactgctgtcatgtgtcagcttatatagctggacagctgaggctgaattcctggaaatgccccctgtattctgaaagcctagactcaaatagcattttgagaactatccatttttatgacttacatttaggaataacacagcctccttttctagccttcctcagaagagtatcaccagaagatactctgaaactctcaacttggtcaaatgtataacataaaggaaggatggaatttggaattctagctagctctctagatttctagttccttgctttgaaaagggaactggaggccggacgcggtggctcatatctgtaatcccaggactttgagaggccgaggcgggcggatcacgaggtcaggagagctagactatcctggctaaaacggtgaaatcccgtctctactaaaaatacaaaaaagccgggcatggtgtgcctgtaatcgcagctacttgggaggctgaggcaggagaatggcgtgaacccaggaggcagagcttgcagtgagccgagatcgcgccactgcactccagcctgggtgacagagcaagactctgtctcaaaaaaaaaatgaaagaaagaaaaggaaactggaagacccaggttctagatctgctactacttatgctgacctcactgtccactcctttaactttggcaatttcaaaagtaattagttagatcagactctgggcaaatcatttagctagcctatatttcagaatcttttttaaaaacacttttttaatacactgtcaaagatttattgtgcttaaaaatgtgaattaaaatatattctgaattttaaaaaatcagaaatgagttttaaaaatggttgatttgtgggagttctttatattctgtgtatgagagagagattttctcagtttctggcttgcttatttatctttaaaattgtgtcatttcatgggtagattgtttttaactttgtaagtccagcttatcaatttgttctcttttttttttttttttttttgagatggagtctcactcagtagcccaggctggagtgcagtggcatgatctcagctcactgcaacctccatctcccgggtttaagcaattcttctgcctcagcctcccaagtagctgggactacaggtgtgcgccaccatgcccagctaatttttgtatttttagtagagacagagtttcaccatgttggccaggctggtctcgaactcctgacctcaaatgatctgcccacctcggcctcccaaagtgctggggattacaggtgtgcatcaccgcgcccggcctattcttttatggttagtacttttttgggtcctaagacaactttgcctatcccaagcgtgaggaaattctatgttttcatctagaaggtttttgattctggtctaagcctatgatcatctcaaattaatttttgtgtatggtgtgaaacagaagttgaggttcactttttcctatacagatgtccagttttccagaaccaaatgtaaagatattttcccccatttaattgacttaaagccttggttgaaaaaaaatgtttatatatatagataggtaggtaggtagatagatagatatccctcgtatggagtggctgcttttgaattctgtatgctgttgcctgcctcatactacgtgttcttgattgctgtagagtaaggcttctggatttgtttgtaaagattattttgggcattttagatcatgtatatttccatagcaattttagaattagcctgttaatttctgctaggattttgctagggataatattgactctattgctcaattttgagagaattgccatcctaacagtgtcgagtcttctgatccatgaatattatatatcttgtcatttatttaggtatttaaaaaattctctcagtagtattttataggttaataaaggtacatattttgttggttttatttctattttttaattttatttttaattatgtgtttctaatacaaagaaacataattgagtttagtatattgacctgtcatactacatttctgaaatcacttattctagtaatttctgtagattccataggattttctgtatatgtaatcatgtcatctaggaataggagagctttcacttttcagtatttatgacttttccttttcttgccttagtgcactgactaggattttcagtactatgtagagtagaagtggtgagaatgtatttactcgtcttgtattgatctcttaggaaaagcatttaatgtcccatgactaagtaaataatgttagctgtagttatttcatcgacatcatccatcagcttcagagagttctgttcctagtttgctgagagttgttattattaatggctattgaattttgtctaatgatttttctgcatttgttgaagtgatcatctagcttttctcctttattctgctaatgtgataaattacattaaatcaaccttgtattcctggaattaaatcattttgtcatgatgtattattatttttatattttgctaaaatcatttttctattattttaaggattttctgtctatgttcacgggtgatgttgttctataattttcttcacataaaaggcttcagaatccaaatatcccttcacaaagattatctgccatataataatgtccttttaagcatgagcacttctgtctcttgtccttcattcaccccaaggatgacattggctattaaatgaaagaaagtgtcgaattagagtcaggacatttgatagctgtttcaccttagtatctccaatctaacatagagaacaatctctgactagaccagtgcacacagtggttctggaaatgaaatgagaaatgagaaagcttcaaaaaccaaatttcaaaataaaagagtatttctcaaaaaaattttttcttcacataatatcttcataacagtttattgttaaatttaagactctagctttttagtttcatatttcataaatttcttcattttaagtttcttctactttctcaaggtttattataattattttgtgctttttagttgaattttttgaattataaatatacgtgtctatgagttttcccctacataaataagtaaataaatattgtatagtatttataatcaaagacatgaaatagtagcaagaatactatatacctcagtcacagataaggttccagtaatgggtctgtagatattcagggtttctgctagctactcctcttctgtgaatcctgtatggtctttgtagatctggcgtttaacctccaggttataaccaagaagacaagtcagtgatgatcagatgacattaagttttatagtccctaccatgctaactctaggcccaaatttgttgactttactactgacattttggaccagataatcctgtattgggagggaaagaagattgtcctgtgtactagaaggtgtttagtagcatctttggcttctgtcttctaactgtccatagcagccttacttgtgacaattaaaaatgtctgtagacgttaccaaatgtcctggagtagggtgagaccagaattgcaacctagatggcaactactgctctaggttgatttctttttgtcatttatgtagacctagtagatttctatgtaatttgtatatatattaaattaccttttcaattaatagcaaaccaggaagaacatggcaaagtcaactgttagctgcttcaaacagtagaaaaattacagattggatattgtcacttgtaccttatttggtatcacaagtagtatctgaaccaaggacgaaacatacacagactaaacatatgtggaaccaaacactatatggttcaaataactgaaaagtataggggattggtgtatgtctattttgtgtctgcttcttaaatgtttcccaccgttttattaatcagggtgaaatacatttaaaaaattttaaacatcagagtgaatggccaggcgcggtggctcacgcctgtaatcccagcactttgggaggctgaggcgggcgaatcacaaggccaggagttcgagaccagcctggccaacatggtgaaaccctgtctctactaaaaatataaaaattagccgggcgtcgtcgcgcatgcctgtaatcccagctactcgggaggctgaggcaggaaaattgcttgaacctggcaggtggaagttgcagttagtcgggattgcaccactgcactccagcctaggcgacagagcgagactctgtcttaaaaaaaatcagagtgaatataaattcataatcttggatagaaagacatattacttgtttgtcatttgtatgataaatgtctgaaatatgcttcacaaactgctatggtggtggcccataaaacattataaataaatggtaacttgttacaataggtatatatttcagagggagtatatattactcagtcttcctaacttttcctcattgttagaaatacagtggggttttctttttggccattttcctctccattataaataagtgtttgtctgaaaagtattttgtgcatagaattttttaaatatataaagccaaattgcttcccaaaaggattaggcgacctccaaagttttcttgacattgttttttccctgccaccctaacttaagaaaacactttaatcatttatttaacattaaaatgtgtaaagtgtgctaatcttaaaatattgtgcacacctgaataactactctcaagatcaagatctagaacatttttaatatgtaggaggtttcctcttgtgtctttatactcaatactcactctcagtggtaaccagtatatgacttctttaaatatttattagttttgcctgcccttgaacttcatgtagataaaatcttttaatgtcttctctcttgcagtgtaatgctgagatccatccatgtttttgcatgaatcctcagtgtattcttttttgttgttatatagtattacactgtattatgtactacaaaatgtccattctcctgttgacatctgagttatttctaacttggggctattatgaataagctgccataaacatccatgtgtatgttttatgggattcagatgcactaatttcttttgtgtatatacctagaaatgtgactgctggattttagcttagggatatgtttagttttagttggttctgtcaagcagttttctaaggtaattgtaccgatttaatctccaaccattcatatgagaattccagttgttctacatccttattaacacttggtttatctgtttctgtgattcttgcaggtgtgttttggtatctctttgtgttttaaaaatgcatctccctgttgagtactgcttattgtctacttggatatccatctttgtgaaatggtggttcatgttttttgttgatttaagattgcattgtttgtttttttcttactgatttataggaattcatgatatattttggatatgcgccctttgtcagatgtgttgcagatatcaatcaatggcttgtaatttcacttgcttaatggagtcttttgctgtaaaatgctcttctaatttagctcaggttatcaaatttttctattcagatttatgtgtattttatttaagaagtcttttctaccttatgaaaaattctgttttcttctagaagcttgattgtgtcagcttttacatttatgtctatgatctcactcaaattaactttttgaatagtgtgaaataagtgtcaaggttaattatattttccatatggatgtctagttgttccagcacttaattacagtggtatcttggttataaatcaagtgaccatatgtgtgatcaccactctaacctttgatagctgtctccctaagcatcctacttgtatatacttataacaatgtttaaataattcgggtttggcacagtggctcacagctgtaatcccagcactttgggaggccaaggtgggcagatcacctgaggttaggggcttgagaccaccctggccaacatggtaaaaccccatctattaaagatgcaaaaaaaattagccgggcatggtggcaggtgcctattgttccgtctactccggaggctgaggcacaagaatcgcttgcacctgggaggcagaggttgtggtgagctgaaatcatgccacttcgctctagcctgggtgacagagcaagactctgtctcataataataataaattaattatttctgttcatggtagtcgcacttacttaacagttgaagctctcctttcttcccatgtataagagtatagacaatttgaaccaataattcttctatttctgaatttttttgttttatttattctttctttggaaatggttttcattttttatttgtaagcacacttttcacttaagaaataaaagtaatggttcagtgctggccttttacaagttttgcatgataaccttcatatttatatgtaacacttgagaatttaaaagcttttatgttttcaataataaacttttaaaatagtggttgtcactgcttatattataactcaacatattctgcacaaagtatttaatatgtttagttttgcttacattacttcaacttgttttaccttcaggtcatatcaaaaatatagtgggagctctggaaattactcaggaaagagaataatttgaaagtcaagctatttggagggcagagataagaggttgccagttatatgggttttattaggattctcttcaccagaggctacaaccttacagaactgtgatcagtgattatgtcatgtgaatttttcctttttgcaaactaagctctgtgaacctagatctcagatacatatgactggggactcttgacagttccttttcttccagctgttttattttatactttattatttggtacacttccaggtactttgagaaacagatttaaatattatctctctataaattttttataccaaaagacaatgattatctggacagcccaaggcaggaatatgttacctaatgctcaaggagaggaattaactttaaattccaacataaaacaaaaggttttgacatctctggtagcaactactgtgttttttaactgattaggaatgataatttaaaaaatttcccatatgaaaaactgtttctaaaatgtactaaactttctgatttttctgtttccttagagttcttcttatagtagtgatttataaattggtatttttaaaaattacattttattgaataggtatatccattccctgtttcatcaagtttcagggagaaaataggggaaaagtctgttatatagtatctgatcatttatagtcagcttcaaaattttagaggcttgaagaatatgtctattatatatgaaactgatatgctaaatataatagacatatgtagagtgtagagttttttatttgtttgtttgtttgttttgagatggagtctcattcttgtcacccaggctggagtgcagtggcgcaatctcagctcactgcaacctccgcctcctgggttcgagcaattctcctgcctcagcctcccgagtagctgggattacagatgcccgccaccacacctggctaatatatatatatatattatattctatatatatattatattatatatatatatattatattctatatatatatattttttttttttagtagagatggggtttcaccatgttggccaggctggtctcaaactcctgacctcggatgatccgtccgccttggcctcccagagtgctgggattacaggcatgagccaccgtgcctggccaagtgtagagtttttgaaaatatgttggtcagttaattaggctagaaaatagaatgcatgtgagtataggtatatgtgtatatgcatatagaaatacttctaaaattggtttttaatagaccttttagagcagttttaggttcacagcaaaactgagcagaaggtatacagattgtctatatatcccatgccccaacacatgcatagcctttcctacgatcagcatcctccaccagagtggtctatttgttatacttgatgaacctacattgacacatctttatcaccctgaatctgtagtttacattagagttcactcttggtgctgtacattttataggttttgacaatatataatgacatatatcaactgtaatagtatcatacagaatagtttcactatcctaaaaatcctctgtgtcctgcctattgatccttctctccctctgacccctgatatgcactaatctttttattcccccacagttttgccttctccagaaagtcgtagttggattcatacagtatgtagacttttctgattggcttctttcacttagcagtagcatttaagtttcctccatgtctttttgtgaccttatggcttactgcttttcagtactgaataatatttcattgtttgtgtatatcacagtttatctagccacccactgaaaaacatcttggtttcttccaagttttggcagttatgaataaagttgccataaacatttgtgtgtaggtttctgtgtggatataagttttcatctattttgggtaaataccaagaaacatgattactggatcatatggtaagagtatgtttaattttgtaagaaaccgcctgtcttccaaagtggctgtaccaatttgcatccccaccagcaagaaatgagcgtttcttttgctccacatcctcaccatcatttggtggtgtcagtattctggattttggtcattctgatagatatgtagtggtatcttattgttgttttaatttgcatttccatgatgacatataatatgaaacatcttttcatatgcttatttgccatccatatatcttatttggtgagatgtatttaaggtctttggccaatttttaaattgggttgtttgttttcttgttgttgagttttaagagttctttgtatgttttggataacaattctttatcaaatgtgtcttttggaaatattttctcccggtttttggcttgtcttctcattcttttgacagtgtcttatgcagagcagaaattttatttttaatgaggtctagcttatcaatacgttctctcatttggtgctatatctaaaaagtcattgccaaaccccaaagtcatctagattttctcccaggtttcatcttttgtagttgtatcacaattcttggagattctgttctggttcccctcatccccccagtcttttttctctttgctttcagttttgcacctttcaactgagatatactcaagctcagaaactctttcttcagccatttccagtctactaatatgtccatcaaaggcattgtttatttctattgaagcgtttttcttctccagcatttctttttatttcttagaatttccatctgtttacattatctgttggtttttgcacactgtttactttgtccattagagcccttagcatattaatcacagtttaaaaaaatgtctggtctgataattccagtattattgccatgtcagtgtctggttctgataccctgtatcttcagactatgtttttcacctcttaggattccctgtacttttttcttcctagccaggcatgatgtatgggtaaaaggaattgctttaaataggtttttagtaaggtatgggcaagtgcagggggcagggggaatattctgtagtcctatgagtacatctcagttttttaatgagcctttgcctctggaatgtgaagttcactggtgcttctcagatccctgctcactgccctcctccctctttaggtgggacagaatgactagagggggctggagttaggtatttcccttccctctggtatgttcagctccgatataaacccagcaggctgggttctggtaaactagttgcttctgagagtagatctttgtaagggtagagtactcctgcatatttcaaaatagctacttcccccttcctcttgccagaagcaccagctttttctctgacattcaccgtgagaacctggctgagttcatgcaggtaaaactcacaacagtgtggggacccccatgttactgagtcctcctagagtttttgaccctcagacttgtcaacactgagcctccatcaatttgtcatttacagtttaagtttttctcccatggcactcatttctgcttgtaggtttctacatggataaattgtggttcttcatatctgcctgtctacctgtctaatttttggggcactggtttgccctgtgacctcacctctcttacagatctaagaaaagttggtttttcagtttgttcagttttttacctgttaggacagagttgcaacttataagctccttccatgccagacgtgaaaccatccccaaactgattttttaaatatcccatatctttataaaagtaataggaggcaacctaaaataaaaatataaaatcctctccctccccctaaaaaagcctaagacagaagatacacttcaataaatgcagaggaaggagataggaaacccatattaaaatatccagacaatagatatgaccctaatttacccagaattctcaagctccagagatcatggcagacagagatactgttagaatttgcctaattctccactggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcccgaagtggggtcttagattttgtattattaacaagcttctagatgatgctattggaccatactgcaagtaccatgaaggttctaaagcagccaccaatatttactaagaactttaccagctggcctgtagtcttttcacattgacctgtgccataatcctaggttatctcttttatttatttttctgagatggagtcttactctgtcgcccaggctagagtgcagtgacatgagctcagctcactgcaacctccacttcctgggttcaagtgatcctcctgcctcagccctccaagtagctgggattacaggtgtgtgccaccaacccagctgatttttttttttttttttggtagaggtggggtttcaccatattggccaggcttctgttgaactcctgacctcaagtaatatgcctgcctcagcctcccgaagtgctgggattacaggcgtgagccaccgtgcctgccatctcttttaattatttcatttcaacttctataaattttattttcactgcatttttaagccataatcttacctagattttatcattagaactctcccacctctaaatcctgtatttcagggtattactttgattttatcttttagctttcttactaccttacttatagggagctgggtctctaacctcagtgagatttccagaccctgacatcattattttacctgagcctaacagtctccttcttacagtatattctttgctgaacctgaagttcacctccaccgtttaaatgtctttcataccttcatctttcttgtcttttgcttacccatccctgtatcagaattgcagttcagcttctccatttctttagctaggttgctgaatatatctaacagaaaattatattctccagattggtgccattacaaatttatggtattcattctcggctgggctcttgtttttttgtttcattttgttttaaattgagacagagtcttgctctgtcgcccatgctggagtgcagtggcgcaatctcggctcactgcaacctccaccgcctgggttcaagcaattctcttgcctcagcctctcaagtagctgggattacaggcatgcaccaccacgcccagctaatttttgtatttttagtagagatgggatttcgccgtgttggccaggctggtctcgaactcctgaagtctggtggtctgccctcactggcctccgaaagtgctgggattagaggagtgagccactgcgcttagccggttgggctcttaatgctgctgttttttgaccctagactttcctggatgaggaaggcattcttttgcatgcatctgaaaagtttaccactagagagaaaacacttttgaggaactaaaggagatattgtgtgtgtgtgtgtgagtgcccatgtagaaataaggacgaagtattctggaaaatagaaaatgttgtttagtgtttcttagcagttaacaaatgaaagagccccgctcttcaagtggctcttgctatgtctcttgctattgtcaggttaagccataactctctgtttctcatcttatgcagtttaaggataatatattagatgaatgctgaagaaagtgttagttatttatctaggggaaggcttagcatctagatagggaaaggatgaggaaaaagagatataaggacagcttttaccaagagagataataggaatgaagtgaaaatggggaaaaaatgtgatctcttgggtgagagaaggtagattaacaaatgaatttgaggctaagtcactcagccttatgtcgtagacatgaatataaagaacctattttgtattacaaatactgttaatagatatatcatggatttttacattttgtatttaaacaggcagtttggaaatcttctgactaagcattttgaataattgatattcagaatatcatttgtcatctatgaagatatttgatgaaatgaatttgcatttaaacattcgtgatgattctgagtaggaaaaatacacagaagaacaaagcacttaattatgtttctttaaaaataaacgccacaaaaagcatttaaaaataagataaaatatagtatgtagagaacaactatatctcagaatttagattattttgtaactgtatacaggataatagaatatgtattttaatgtatacattatattgaaagatttgtagaatcttttttttttttttttttttttgagatggagtctcactctgtcacccgggctggaatgcagtggcacaatctcggctcactgcaacctccgcctcctaggttcaggtaattctcctgcctcagcctcccaagttgctgggactacaggcatgcaccaccacgcccagctaatttttgtatttttagtagagacagggtttcaccatgttggtcaggctggtcttgaactcccgaccttgtgttccatccacctcagcctcccaaaatgctgggattacaggtgtaagccaccacgcctagccaagatcttgtagaatctttaaaaaaaatcttcagacacagcttaaatatcactcttttaaccctttgtaaatgaactcagtctcctttctttcaaagttccctttaggtctaggttatttctttttttttatttttatttttattattatactttaagttctagggtacatgtgcacaatgtgcaggtttgttacatatgtatacatgcgccatgttggtgtgctgcacccattaactcgtcatttgcattaggtatgtctcctaatgctatccctccccgctctccccaccccacgacaggccctggtgtgtgatgttccccttcctgtgtccaaatgttctcattgttcaattcccacctatgattgagaacatgtgatgtttggttttttgtccttgtgatagtttgctgagaatgatggtttccaccttcatccatgtccctacaaaggacatggactcatccttttttatggctgcatagtattccatggtgtatatgtgccacattttcttaatccagtctatcattgttggacatttttgtatttttttagtagagatggggtttcaccgtgctagccaggatggtcttgatctcctgacctcgtgatccacccgccttggcctcccaaagtgctggtgttgatttctttttcagctagtttgttattgctgtatgtaaatgctactgatttttgtatgttgattttgtatcctgttactttactgagtttgtttagtaattataagagttttttggtggagtttgtggggtgcacggtaacatattcaggcttatgtacaaggcatttgaggtcagggcatggaaaaatactgaggcactgtgtgtatgttatttgtgcatgagactaaaactccttgaccctgaaaacaggacgggaagttgagttcatggtatgataaggaacgctgaaaacagcctcctaataatgcagtttaagtgtttttacaaggccacaggtgtctcacgacccagcctcaaaaaagccatctagtggatgtttgtggtttaacaagccctttctataagtaattggtgggcggatgctggggcggactctcttagaaaagctgcccctcaccccgctcagctgaaattgtctaaaaacttcttggcattcactgcaagctataagctctgcagagttaagggttttctgtatagaaagtcatatcatctgcaaacagggacaatttgatttcttctctcccaatttggattccctttatttattttatttatcttgcctaattgctctggctaggacttccagtactgtgtggaataagagtggcaagagtgggcatccttgtcttgttccagttcctagaggaaaagatttcaacttttcctcattcagtaagatgttagctgtggttttgtcatttattgcctttatcgtgtttagatacatactttctgtacctaatttattgagaatttttatcacgaatgactggcaaattttgttaaatgctttttctgtatttgttgagatgatcatatagtttatgttctttctgtcaatgtgatgtgtcacaatttgatacaaatggtaaaccatccttgcattcctgggatgaatcctacttgatcatggtgtatcatcttttgaatgcactattagatttggttttctaatattttgttgacaatttttacatctatgctcatcagggatattggcctgtagttttgcttttttgttgtgttcttgtttggttttggtatcagagtagtgctgataccagactcatagaatgagtttggaagcattcctccacttcagttttttgaaatactttgagaggaattggtgttagttcttctttaagagtttgaggccgagcatggtggctaacacctgtaatcctagcactttgggaagccaaggtgggtggattgtttgagctcagaagcttgagaccagcctgggcaatatggtgaaacactgtctctacaaaaaatataaaaattagccagatgtggtggcttgtgcctatagttccagctacttgaggggctgaggccagaggattgcctgagcttaggaggcaaagattgcagtgagctgagattgtgccactgtacttcagcctgggtgatacagagagagaacctgtctccaaaaaaaaaaaaaaaaaaaaagagtttgatagaattcagcagtaaagcgattcagtcctgggcttttctttttttttttctgagtcggagtctcgctgtgttgcccaggctggagtgcagtggcacgatcttggcttactgcaaactctgcctcctgggttcacgccattctcctgcctcagcctcctgagtagctgtgactacaggcgcctgccaccacgcccagctaatattttttgtatttttagtacagacacagtttcaccattttagccaggatggtcttgatctcctgaccttgtggtccacccgccttggcctcccaaagtgctgggattagaggtgtgagccaccgcatccggcctgtcctgggcttttctttgatgcgagactttttattattgatcccatcttattactcattattggcctgctcaggtttgttgtttctttctggttcaatcttggtaggttgtatttttccaggaatttatccatttcttcttggttttccaattttttggcatatatttgcttatagtagtctttaatgatcctttgtatttatgtggtcttggttgtaattcctctattttcacttctgattttatttatctgggtcttctctcatttttcctagtatagctaatggtttgtcaaatttgattatctttaaaaaacgctttttgtttcattcatcttttgtattttttaaagtctctatttcatttactttcactctaatctttattctttctttccttccagtaattttggttttgatttgttcctttttagttccttgaggtacatcaatatgttaggtatttgaaatctttctactttttttatacaggtgtttcttgatggtaaactttcctcttagaactgcttttgctgtatttcacaggtttcgataggttgtatttttttgtatttgtttcatgaaattttaaaatttcctttttaattttttcgttgacccattggtcattcaggggcatgctgtttaatttccctgtatttgtactatttccaaagttcctcttggtattgatttttagttttattccgttgtgatcagaggagatagtatgtgttttttcagtttttaaaaatttgttgagatttgttttgtggcctaacatatggcctatcctggagaatggtccatgtgctgatgagaagaatgtgtattctgcagctgttgaatgaaatgttctgttaatgtttgttaggtccatttggtctatagtacagtttaagtctgatgtttctctgttgtttttttgttgagattgtttgttcattgctgagaattggatgttgaaatcctcaactgttattgtattggattcagtctcttcccttagactgaatatttgctttgtacatttggatgctttgttgtaggtgtgtagatatttacaattgttatatcctcttcctgcattgattccttcgtgattatgtaatgacctttttggtctttttttaaaagtcaatttaatcttatataagtatagttcttcctgctttgttatttatttatttatttgagacagagtctttctttgttgcccaggttggtatgcagtggagcgatctcggctcactgcaacctctgcctcccgggttcaagcgtttctcctgtctcagcctcctgagtagctgggattacaggtgtgcaccaccacacctggctaatttttgtatttttagtagagatagggtttcaccatgatggccaggctggtcttgaactcttgacctcaggtgatctacccacctgggctcctaaagtgctaggattacaggtgtgagccactgcgccccacccctgctttgtttttatttccatttgcatggaatcttttttgcatcccatatctttaagtctgtcttggaatctttttcatcctatacctttcagtctgtctgtctttacatgtaaagtgagttttttgtgggcaaaatatagttgggatttttaaaaagaaatccgttcaatcactctatatctttaatttgggaatttaataacagtcaagattattgatgatacattgaggacttactcctgttatattattgattgttttttgattgttttgaatttcctttgttctcttttttcctctcttgtttatctttgcagttcggttgatgtctgtagtgataaggtttgatttctctctttttcagctgtgtatctgttctacctgaattttatactttatactgttttcatgaggcagttattgtccttttgcttccagatgaaggatgcctttaagcatttgttgtaaagctggtcttatggtgatgaattccctcagtttttgcttgcctgggaaatactttatttcatcttcatttccgatttttgctgggtatagtattcttgtttggcagtttattttgttttcacagtttagatgtatcatcctattctcttctggtgggtgagctttcttctgagaaatcttctggtggtttaatgacaatttccttatatgtggcttgacagtttcttttccctctgcttttcgaattctcttttttttctttcgtttttgatattttgattgtaatgtggcttggagactacctttttggcttgattctatttggggacttttgagcttcttcatttgaatgtttataactctcccatgacttgggaaacttacaactgtaatttcattaaacatgtttttggtgccttttttcatctcttctccctccagtattcccataatgcaaaaatttgtttgcttagtggtgtctcataagtcctgtaggtgttcttcattcttttttattctccttttttgttcctcctactgagttatttcaaaagacctgttttcaagttcagaaattctttcttctgatgatctattctattgttgaagctattgattttatttatcatttcatttattgaattcttcagctccaagatttctgtttggacctcttctatgatatgtatctctttgttgggttttcactcagataacaatttttttcctgatttctttttattatctgtctttattcttttgtatttcagtaaattttcttacaatcattattattattttttttttttttgagacggagtcttgctctgtcacccaggctggagtacagtggcgcagcctcggctcactgcaagctccgcctcccgggttcacgccattctcctgcctcagcctctccgagtagctgggactacaggcgcccaccaccacgcccggctaattttttttttttttttaatttttattttttttatttttttttatttttagtagagacggggtttcaccgtggtctcgatctcctgacctcgtgatcctcccgcctcggcctcccaaagtgctgggattacaagcgtgagccaccgcgcctggccacaatcattatttttaattatttttcatgcattttgtagatttccttttctttgaagtctcttatgggataattatcatgttctttggaggcgtcatttttctttgctttatcattcttcttttgtccccatattaatatctgcaaaactagtggaacagtcacctctaccaattttttatagtagctttgtagggaaagactttttcttgtagttgtttcctgtcatgttggatgtgtagggtaatttagctttagttctggttgtatatagtaatgtggtctctgtgtggtatttttggctgtaatcagcatgtattagtccattctcatactgctataaagaactacctgagactgggtaatttatgaagaaaaaaggtttaatcgatttacagttccacatgtcttgggaggcctcaggaaacttataatcatggtggaaggcaacagggaagcatagaacttcttcacatggtggcaggagagagagagagagtgaagagggaagtactacttttaaaccatcagatttcatgagaactcactcactattatgagaacagcatgaggaaaaccacctgcatgatttgatcacctcccaccaggtccctcccttgacaggtggggattacaattcaagatgagatttggatggggacacagagctaaaccatatcatttggcccctggtccctcccaaatctcatgtccttttcacattttgaaatgcagtcatgcactcccaacagttccccagagtcttaacttattccagcattaacttaaaggtccaagtccaaagtctcatctgagacaaggcaagtcccttccgcctatgagcttgtaaaataaaaaacaagttagttacttccaagatacaatgggagtataggcattgggtaaatgtttctgtttgaaatgggagaaattgaccaaaacaatggggccacaggccccatgcaagtctgaaacctggcagggcacccattaaatcttaaagctccaaaataatctttgactccatgtctcacatttagggcatgctgatgcaaggggtgggcttcaaaggcttggccagctctgcccctgtggctttgcaggtacagcctctgtggctgcttccacaagctggcattgagtgcctgtggcttttccaagtgcacagtgcaagctgttggtggatctaccatgctggggtctggagaatagtggccctcttctcccagctccactaggcagtgtcccagcggggactctgtgtgggggtttcaaaccccatattttccctctgcattgccctagtagaggttttccattagggctccaccctggcagtagacttccatacatcctctgaaacttaggaggaggttcccaaagctcaattcttgccttctgtgctcctacaggcccaactgcatggaggccaccaaggcttggggcttgcattctctgaagtaatggcctgaattgtaccttggcctcttttagccatggctggagcctggaggagctgggacacagggtgccatgtcccaaggccccacccacaaaaccatttttccttcctaggcctctggcctgtgctgggaggggctgtcatgaagttctctgaaacgccctggagacattctccccattgtcttggtgattaacattttgctcctcattacttatgcaaatttctgcagcctgcttgaatttttccctaaaaaatgggtttttcttttctgtcacatcatcaaactgcaaattttctaaactcttgtgccctgcttccctgttaaacataagttccaatttcagatcatctctttgtgaacacatatgactatatactttcagaaaaagccaggttgcttcttgaatgctttgctgcttagaaatttattctgccaggtaccctaagtcatctctctcaagtttagagatccccagatctctgaggcagaggcaaaatgctaccagtctcttcgctaaagcatagcaagagtgacctttactccagttcccaagaagttcctcatctccatctgagaccatcttagcctggacttcattgtccatattactatcagcattttggtcaaaaccattcaacaagtctctaagatattccaaagttttccacatcttcctgtcttcttctgcactctccaaactgttccaacctcagcctgttacccaattccaaagttgctcccacattgtcaggttatctttatagcagtaccccagtatcctggtaccaatttcctgtattagtctgttttcatactgctaaaaagaactacctaagactggataattaatgaagaaaaaaggtttaatgaactcacatgttccacatggctggggaggtctcaggaaacttacaatcatggcagaagtggaagcagggactttcttcatatggtggcaataaacagagagagagaagggggaagtgccactttttaaccatcagatctcgtgagaactcactcactatcatgagaacagcatgagggaactgcccccatggtacaatcatctaccaatgggtggggattacatttctagatgagatttgggtagtgacacagaaccaaaccatatcacagcgtcagtgatgtctgcaaatgactcagtagcctagtggtttatggaaggagtggtgtggcttttctcactgtgaagccaactgagtgggccggttctcaggccctgagtaggtacatgtagtgtccagtggctccactggtcacagggccatggttgccagtggcagaaggtggcaggtgggccaggcctcagatctgggaggtgtatgcagcctatggtggcactgttgatcaaagaaatggggttgctggtggcagtgggtgctggcccaccattcctcacaccctgggaggcatgtatgttggctcccctagcctgctttctgtgctagaccaccgggagtatagtacacagtgtggtacctggtgccaggatcatggctgtcccatgggtctagctgaagtcatagcattacaagtatataggcatagtgaaatgacagtggagccccatggatgtggcaatgcaggggctgttggtcccaggtcaggatgaagtctagaagtggcactattcccaaaaaggtgctgtgctagtacaccttgggtcctggggagtgggggttgccagtgtgaattttttatctggagcagagcagctgtgtggactaaaggcagcttcctatcccgggctcagggcctgtgacaactgtggggctgccatcctgagtttctgtgcttcacagggtttttgtcacttccttgctgaatttcagtgttcttctttagactatctacttgaagtacagtcatttatttgttttcgccttcacaccatggtaaagctgaaaaatcataagttaaatcattgtaagtcagagaccatatatacttgaaaaatgctaagacagtagattttaaatgttctctctacaaaaaatggtaactatgagagataatagatatattaattatcttgatatagccattccacgatgtctgcatatattaaaacagcatgttgtactccctctccttcttcataaagaagatgaatgttgggcacgtctagtccaccatcttgatgacccctattctcttacctaaatagttggtgagataaatttttcacagtagaagtatttgaactgacaagaatgagtaatagaattattgtatcatcattttttaacccttaatgaaaaagtataagatctaggcagcaattatcaccgacttctaatatcacacacagagagaaaataatctaagtagttagcataaattatggagtagtcatgccaaatatttagaccagaatctgattaagtctccagatctaactactaatttgtaggtaatacatgaaacagagaaacatggtaagtgaaactatgagaatgcaataagtaaatgtagagtatggaaaatcctgtaggagaaacaacccagtttttcaacaaataaattgtaagaaaaaattaaaggaaagataatctatagatttagaagattgtgggttttaaattgataatgtcaagagggttttctttttttttttttttttttttctatttgagatcttgccaatagattcatttttatttttcttgttgcaggcaagcatattaggggctggctaagcaaaaaaaaaattttttttattattattatactttaagttttagggtacatgtgcacaatgtgcaggttagttacatatgtatacatgtgccatgttggtttgctgcacccattaactcgtcatttagcattaggtatatctcctaatgctatccctcccccctccccccaccccacaacagtccccacagtgtgatgttccccttcctgtgtccatgcgttctcattgttcaattcccatctatgagtgagaacatgcagtgttcggttttttgtccttgcgatagtttactgaaaatgatgatttccaatttcatccatgtccctacaaaggacatgaactcatcgttttttatggctgcatagtattccatggtgtatatgtgccacattttcttaatccagtctatcattgttggacatttgggttggttccaaatctttgctattgtgaatagtgccgcaataaacatacgtgtgcatgtgtctttatagcagcaggatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttcaatgatcaccattctaactggtgtgagatgtatctcattgtggttttgatttgcatttctctgatggccggtgatgctgagcattttttcatgtgttttttggcttcataaatgtcttcttttgagaagtgtctgttcatgtccttcgcccactttttgatggagttgtttgtttttttcttgtaaatttgtttgagttcattgtagattctggatattagccctttgtcagatgagtaggttgcaaaaattttctcccattttgtaggttgcctgttcactctaatggtagtttcctttgctgtgcagaagctctttagtttaattagatcccatttgtcaattttggcttttgttgccattgctttcggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttgtacatatggctagccagttttcccagcaccatttattaaatagggaatcctttccccattgcttatttttctcaggtttgtcaaagatcagatagttgtagataatgcggcgttatttctgagagctctgttctgttccattggtctatatctctgttttggtaccagtaccatgctgttttggttactgtagccttgtagtatagtttgaagtcaggtagcatgatgcctccagctttgttcttttggcttaggattgacttggtgatgcgggctcttttttggttccatctgaactttaaagtagttttttcgaattctgtgaggaaagtcattggtagcttgatgaggatggcattgaatctataaatttccttgggcagtatggtcattttcacgatattgattcttcctacccatgagcatggaatgttcttccatttgtttgtatcctcttttatttccttgagcagtggtttgtagttctccttgaagaggtccttcacgtcccttgtaagttggattcctaggagttttattctgtttgaagcaattgtgaatgggagttcactcatgatttggctctctgtttgtctgttattgctgtataagaatgcttgtgatttctgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgtccgttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattaatttgcatatattgaaccagccttgcatcccagggatgaagcccacttgattatggtgaataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttccttcttgtacctctggtagaattcggctgtgaatccatctggtcctggactctttttggttggtaagctattgattattgccacaatttcagagcctgttattggtctattcagagattcaacttcttcctggtttagtcttgggagggtgtatatgttgaggaatttatccatttcttccagattttctagtttatttgcatagaggtgtttgtagtattctctgatggtagtttgtatttctgtgggatcggtctcttttcaaggagactccctatattttagagttacgttgctaaaatacatgtagatgaaatgatatgatatctgaagggtaaatgtggaatgagtaaataagactgggcataaattgataatttttgaaactaagtgataaatagtacatgagggttcatgtactgtttattctttttgctttttcttctttcatgtgtttatatttcctgtaattaaatgtaaaacaaaacagaagccatgtgcttagatcataactcaaaccctttttttagccttgaggttcaacctagtctgacctctacttacctcatctctaccatgcttacccaagttcagagtacatttattttcttccctttttttcagatataccaatttcattaacactttagggcccttgaacttatggctgttctctctatctggaaactttaccctttagatcattagtgtttatttctcgatatacaggtcttatcttaaatgtcatctcagaagagcaggctgtcaccatcactatcatcttatcttattttcttcaaaatgctcatcatgatttgatgtctccttttatatttattgatagtttccatccattagagtgtaagttccatggtggtgatgctgtcttcttgactatcttgttcactgttaactttgcagtacttcaaacaagtacttggcaaatatggtactcaatgtttattgagtgaatcaattaaaagttcataaagctgtttaattataagacatgattaatcttttaatatataacatcagcaatatatagtacaattgcctagcaaaagtatttgaaattcagttggcattttcattattaatgttttcaaaggctcatgtgtgggaaaattagctcttagcaaagcttcagaaaaatgtagaaaattcacaaaatgtcaaattttctcttagcatttattttaaaatacctgcattttccgtaattaatgtcatgtcttgtttaaggctgttttttatatccagataagcagagattaagttttatgtgtgtttatatgtgatatgaaaattgggtaatagttcttggcttgttaataattatgaaatattttcaattatatctcccatcaaaaaggaactgagaaacaccttagaaataaatgcatagaagagatgagaccataaaattataagacctactcttttttaaaaaaatacatgaaatactattttgtcattcaaaataactactgagggaagttgtccataatggttattgaataaaatgatctgttttactaatgaagtaattttgcattctactgtttagtattgaagattcatgtaggatgcaaaaactcgtgggttcccttctcctgagtgttaaagaagacaagcttttcctccatggcacaataggggatgaagacttaggcttgttttaccatagccaggtggacggttcctcttaccatcctccatgtatggcacataggagtcttagaacataccctttccaccagaaacatcccactatcgactttaaaaaaaacaaaaaacaaaaaaaaaggtctcctaagtccaaagtgctatagatctagaaaattcttcaaatttggctccttgccaggacagtttttattctgagaagattttgtaatttgtttattcttttttaaatttctttgtttttttctttatttaatacagctttattgtggcttgtcgtgtagaaaacactatgagattataggggataatatggagttgcctttgataattttatttttggaacttctcttttggaattacctttataatgagtcagttacatatatgccgcatatagtcgtatctttttttctaatggaagataaaatttttatatttattaattttgaaattatttttacttgacaaatattgtatgtatttttggtatagaacatgatgttttaatatatgtagacattgtggaatagctatataaagctaattaattacctcatatacttagcatttttttgtggagagaacatttcaaatctgttctcatagtaattttcaactacatatggtgtccaacttacaatgatttgacttatgatttttcaactttaccatggtgtgaaagcaatgttcatctagtagaaactgtactttgaattttgattctttcttggggtaatgatatgtggtataataaatattctcttgtatcttgtatgctggcaagagcagcaagccattctgttactcactttcagtatggtattcagtacattacatgagatgttcaacactttattatataataggatttgtgttagatgattttgcacaactgtaggccagtataagtgttctgagcatgtttaaggaagggaaggctaagctatgatgtttggtagattagttgtattgaatgcattttgactcacattattttcaacttagtatgggttttttgggacataaccccactgcaagttaagaagcatctctatacagtatattgttattaactgtagtcaccactagagttgtacaatagagttcctgaactctattacttctattactctattacttctgactttagtgtgtgtgtgtgtgtgtgagagagagagagagagagagagagagagagagagagacagggtgtcactttgcagccaggctggagtgcagtggcacagtcatggcttactgcagccatgacttccctgggcttcctcccaccttagcctcctgagtagctggggctacaggtgtgtaccaccacacctggataatttttgtattttttatagagatggggttttgctgcgttgccagtctggtgtcaaactcctgggctgaagcagtccgtccacctcagcctcccaaagtgtttggattataggcatgagccactgcacctggccttactgcaattttgtgtactttgaccaacactcccccattcttccactataactgccattctattccttctatgagttctactttttagattccatatataagtgagatcatgcagtgtttgtctttttgtgcctggcttatttcacttaacataataccttctagattcatccacgctgtcataaatgacaggatttccttccctttttcaggctgattagtattccattgtgtatatgtaccacatttttgttatccattgatacacacttaggctgattctatatcttggttattgtgtcatatattgattaaaaaattacagtttacagtattgcctatttaccagatctggctccatctactttttacattttactttatttatttatttatttatttagagctagggtcttactctgttgcccaggctggagtgcagtggtgtagttatggcacactcaagctccttggctcaagtcgtcctcccaccgcagcctgctgagtagctgggattacaggcatgaaccaccatacccatcttactttttacattttaaaattcaaatccattctcataggaaaaaggtttgttaccaagatatttgaaatattacactttgtaagtagttttaaaagaggtgtgtgaaaaatgttttcagcagccacaacaccattaaatgatgtatatagcctttcaagcttacaatatttaagaagataacacttctgaatttttttttggagatcagtctcactctgttgcccattctggagtgcagtggcacaatcatagctcactgcagcctccaactgtccaattcctgggctcaagtgattctcccacctcagcctcccaagtaggtgcatgccaccatgcgcggctaattttctaaattttttgtgtagatgaggtcagtgcttttcaattttttaattacaaagaaaatatatatcctgtatagactcaagcagcatcaatacagaaatatataaagtaaaagagtgaaggcgtcccacccctggccttgcccactctcaccatttggagtaataactcataattgcttagtaagcattttcccagacttttcctaggtacatacatgtatgtgtgtttacctcagtataggtttctcccttagtagtgaagtgatagtagtcatatagtttagcaacctgccttttttcacttaataatatattgtgatcagtacatataaatatatctcattctgtttattggcttactagtatttcgtagtattgagtgacagtaatttacttaatcattatcttattaagcaacactgatatttgatcctagttttcattattaaaaataatactgcattcagaatccttgtgtatgggatagcactgattttggatatatagtttctgtgttcatcaaagaatctaacaaagcatggattatgagtgtacatgtatgtacatgagctaagtgagacaaattattacctatatgaatttgatgttttcctaggtgcctttacattgtactaagttttttggggatcagttttataaataatttttcaacagaaacatatcagaaagtttagttaatcattctttaattacccaggatgaaattgaattgttgctatagctaggtttttgggaaaaggacaaatttgcaggttcttcagagagctttggtttttaaaatataaggtgaaagtatcttttaaaaatcttttctaactatgttgtaacttgagtattgtggataggccttgaggcaagtatagtactgctcaatcatttgggaagttgaaatcatattcaggaactttcttacttaactgaactagaatagcttttaacatgtgatagcacctataaaattgattaggaaagaaaagcttaggatgagtagtttttgaaggacatcaaataccttacttgtagcttcatgggtatttggctttacttcactttgatggtcatcactagacaaatcttcctcttatatggaaatcatgcctaaagcatattctagtatagaacccaaggccttcaaaccacccagtaagtgttagtattgatcttggatgcttcatatttatgtgaatgactatgttagatgacatattaaatgattcagttgttacaaaaatacaaatttaggagtattcatgaaagcttcatatacagaactttgttgccataattgtttggcaatttaaatgcatccagatccagtttttgggaaattgttgctcctgcacattgggacttctgtggcccacactgctaatgggtgtggcatagccttccttgaaggcaagaataccagttagtcttttttttttctaatgaaaaaacatttttacatttgcacatctgattttggagcacatgactttcagattcatagataattgctgctgagcttagcttataatgtttggccaaataatttctatcacaagcctgagattgctgattgagaggacttagccaagtaagactaaccaataattcttgagttttcttcatagatccctcatgtagcttattgaatagtcttcataaaaccatgaaaatattagttatgctctgagcttcatcacgggtctatgtgagaaatgtatatgcctctatttcttttggaggatgatgggagtggaagaggaacagtggggatgaaggttactgttcttgaaagggtgtacattttctagaaagaatataggctttgatgccagaggtcagtagctttggtggttggagggtgtggaaggtctcttttgattgcctctgtgtttatcaagaaaataacatctttattgcatccatgtatgcctggcactatgcttagcctgaaggtactaaagtaaataaaacttgtcctttgtccttaaaagagagagttcactatctaataagaacagagaagtatggctctattgttaatatacacttcttccaattttttggtttgtgcccaagttttagctttagttttatcaatgtaggtctttttttccccttatgtgttcatatgtccttgattagggaggagagagattgaaagaaagagaaacactgagagagagattgaggtgattgatttattcagaccattagctaacttacattttatgttggcaatctgaatatattttttgttttgatttattgtcctatacattaatatttcagaattactgagagtatgtcttgttttctgatgaaaagtagcttggtcagaactttaattttatttgctcattcataactagtttgttgtgttaaatacaagaatctaacattaaattatgcctgtttgatgcagttttgcaaaagtgtgcattcgtcttgtcaaaaattatttcaactctagaagagaaaaaaagaattacattaaaatgtgacttacaatttataatctaattaacagtccaactgataataaaggtttttaaactgacagtcatgatatttgaaataaaaatgacttatctggacactggtactgaaactaaggcagacaaaatatgctccaaatagcacatttttgtcacgataatcttacttgagaaaccatagatgattgagttagttagttttgatatagaacacaggcctgtattgagccctatcatgatccaattattttttcttctatttcatggcatggcttacacctcaaactctggcctgcattctgttatgtatgtgccactggagacagggacagatgagagaaaattagagtacaagctttactggtttataggtctttgtcataatttttatttgggtaggatataatgatgcttatgtaagtaatattagtttcagttttatagagagcaaactgagatgattttcaccaagattacaagggatgtactaattggtttctttattgtattcctatctccacttcatgagggtagggacttcagggatcttgttcattgctgtgtccccagtgtctgcaacagtgcttggcacatgtaaatgtttgtattaatttctgagtcatgactgaactccataatgattatcccattatttatactcagactttacatatgcatattaatgtgtgatctgtaatataagataaatatgaagacagcagatacctatttaggcaagaacaacctctagatacattgcaacattcacttgctcatcagggcagaagattattatgagcaagtctagatataatgaccaatgtacttaaatgagaatgaagaaacagctgctcacttaatggtcttttaatgagatgcataaaatttggtccattctcttatttctttacaatttagtgatcttaagtttcttagatgtcctttaggtatttccgaagtaattttgtagcttagcaagttgcaaagtgctgaagttgataacatgggaactaggttgttttatgtgttcatttctttctccagttcttaatcctatttctcaccgatatctttatcatctgctttgcaattctcatacatgtattccttaatctttctcaaaatcttttgtgttataggtaagggctcctgcattatttagttctcactaggacacctacatattacattaaatttattgttttctcttcagctttgtaagtggcaagtctatttaacacgggaaagacataggtcactaaaatgtaggaatttaattgatatattcaaaaaaaaggtctgacttctgcttacttcttagcttccatttttagtcctttgttattttaaaattgtattttggcccaatgtttccacacttcgttttaatcttgagaactttccctttaattttcaaaaagccatttaactccacttaagtcatctaggcacatggaaaagatatttttaaaattacacattcagatcattttgtaatgtgattacctcacaaatgtacaaatatgttcttagcatttcgttctaagtgtaaacatggtacactcattgagagaaattttaattttgacttatgataacctggaccaaggaggatggggccatattaggcttgactctgccttttagctggtgttctaggtgctgaggacttgtccccaggcccacatggccacctgtccacatcccgaatttacagattcaaatctaaagacataagctcacagacaaattaatcaaatacttaattcataaaagcaacaggtttttttttttttgccttaaaacatctagcagagacaacataaatctgcctgaatagactcaaaaatatctaaattaaattttgaaaatgtttctcttttattttaccaatgattttaaagctatctttgtttaccaaagattactaaagtcatgtgaacttgaaaagcatttgggctaattaattttgactacctctttatttataagccagtttggtaccataaagaatatataaacagacatgtacacatatgtatacacaaaaatacagacagacagaaataaggatcttacagctttagttttaaaactttagccatgagttaggtaaaactcactagtttaaaaggacagttgtcactcttataaatggaacaggctgaaatttatatgtctcatatggcccaagcccttactgagttatagaaaaaaagcagggtagcaaatttatatctcaaagcacacacaaatagaatttaagttttaaaggagtttggttgtgtttgttagaggaagattaaaaatggatgccaaagtaacacaaaatcatagggatttaccacaggattttatgaggagaccaattttatttagaatgatagtttttaacttagtctgttttccaactggaccattgagcgcagggtagagcccattaaatggagcactgtcaacaaagcatttgcagtttttagggcctagtcatttaattatgtgaaaagcagcctccggttggaaggcagaacatttagattttttaaaataaaggattctgcttttacttgaacccccagtgtcctgaaagaggaaaacaccatgggacccagctgcacaatgtttccacagtgtactttgctccaaagaaatttctctgagtgtttaaacttcacctgtcttatctaaatgctcaaagaaacaagtagccccattatagtaatacccatttactataaacaactgctgtcggccacctccaaaactgcagttatcgccattgacttatcagccatcacatacaacaaagtcaagtttctctctcacaactgtaaagtctcaaagtaatctctggtaccccaaaagccagtgagatcaggtaacacaaatacaaatgagagtagagttttagaattgagaagaatctgcctacgattctttaaattccacaggaagaccgaagacccccaaaaggggttgttggcaccttttcctttgttccttatggagtctgattcattagaagttcctcccagattattttatgtggtactgaagatggcaaagaggaagaaagagtagggagaagtagatgggagaatagttcttaaaaaaggaagcagagggaacaaatacataattaaaaaaaaaagattttaatctactgaaaaaaattttctaacggcaaaatccaaacagaagataaaagtgcccccctcaaagccccatatatatatcagctttaattaagctgacttctgatcatagagctctttttaaaaaatccattcaaatctcttgttattagattttagccaggacaaacagctgctatttctggcttatttatttattttatgtattttttgagacggagtttcgctctttcagctcttggctggagtgcagtggcgcgatctcggctcactgcaagctctgcctcccgggttcaagccattctcctgccttagcctcctgagtagctaggactacaggcgcccgccaccatgcctggctaatttttttgtatttttagtagagacaggctactaaacaccatcaccgtgttagctaggatggtctctgtctcctgacctcatgatccgcccgcctcagcctcccaaagtgctgggattacaggcgtgagccaccacgcctggcttatttctggctgttttaaccaaaggtaacttaccaagtagcaaagcagtatccccacaagttgaaattcacacaaatatcaaaccaacagggactgcttccctgactgggaattgaacctaggatgcagcaatgaaagcacaaagtcttagccactagaccacagggtggatgtgtttttttattttgttttgtgtttttttttgtaaatcttgcagggaggcgaaagcaggcagtttgatcatttaaaggatttttggaaggcttaggtgggagaatggcttgagcccaggagatggaggctgtagtgagccatgatggtgccactgcactccagcctgggcaagagtgagaacatgtctacatacgtacatacatgcctttacatacatgttccagatctgatctcacctggcatactgcttagctaactccctgaatattcatgtttcaacagtgttagtcattagtcttggtttagaaaaagtttgttggatctgcatttttataatcttagtaattttattgtcatttatttctaccttttagactatcagtcttccaattacctgtttcattgccctaagcagttgttggctagacaacaaagatgtattttggagacccatcttttcaatgggtggtgtttttaacttagcttctgtttcttagctaaaattcctgagtttggcaggagcctatcaagcaatagggcaaagaaaatattctcatcttagatagctctgaagaagaagtaagcctactttacctaaggctttaataaacactttatccaggatagctctcttttagccttttgtgaagagttttttaaaataggcaacaaaatgttgaaatctttttagaagcttctgcacatcagtaagcatccttggatgagactaatgcaagagctctcattttgaaatgtattttcttaaagtgcagcattgtttggaacatttcactgccttaaaagtatgccatttagaagaaaacctctggtgcttaactaccagtcctttgacctgaaactctgttgtgaaacagggttggaaaaacttggacctaaacccccagtactgagacaggtggaagcaaaggcatttctctgcagagctctttacctgaatctcctgtccaaagacagagactgaaaccctcactcttaaaggaaaaagaagctttgaaaaacagtctaaatctagaccttcaaccaaagagtgagaggtatgaattcagaagaacttacccaaaacacccattgagacttgtgaagatgaagagttcatcctggtaccaagcattgctttcagagaaacaccaggtggttggggtgggggccatgcaaaggggaaggttcactccgagtcctgccgacttatgccatgtatgtcaatctgaaaggaagaaactaggtaaaactaatataagtagagagtttatttgggccaagcttgaggattgtaacccaggagcacagattcaagatcagccgcagttacaagtggatgtttaaaggcaaaaaagaggacagggagtgggccgatacagagttgttaggaattctcattggtttacacaaataacattgattagtgatggtaatacattgttaagctatagggtatgggctacagtgtccggcgcaacatattatgtcagtttatagctactttatgacaatagcaagcagtttcaggagatgaatacatagctcataggagaaggaggatgtgattacagtctccttttaatgtctctctggacttgataatttttaaagagtcacattcctcagataaaagttattttctcaaccttcaaggagtcatgattgaatcccctcctagctccttacctagaggttggggggacaatcttctcaacaatgtttcaggaatgcattaactttgtaaattttaatgttctttattggtataactcattcttacatacactagaatgagatgtgttggatggcactcagtgtatattgtggttcagtataaatttaaatgaggttttacaaaattcagctaagttttccaaaggaaatatgatcattccattaaaaaaaaagtttgttaaacataccaagtagtttggagctttcctgttcttatataaggtaaccctctccttttttttaaaaaaaaaagcttctttgttattttggtgcttttggataaaaattccttttgctcaccttttccttaaatccctcacaaatatttttcagtttacacaaacagatcatagtcatggtatttttttttcagtagttggaaggaaacttagtgcttacctaatctaaaatagtttattttacagatgagaaaactagggtcccgagaggttaattggctgtcctgtggtcacacagctagtttgtgacaagaatgattagaatttaggtatgccagtctccctaaactgaacttactcctttatttgatgaatagatatctggattcttgtctgtccctagctagatttattgtcttgatttttgccaaacttcccatttcagtgcttgttttttttaatagtaattaatatctgaaccagaatgttaaatctcaaaacttcattttaatagttcatcctgtaattgcctggtgggttcatcttgtccactgcccagacagagctgatgtatctatgcaggggaattgcaatagagagagagtttaatacacgtagagctggctaaatgggagatcagagttttattattactcatatcagccttccccaaaatttggaggctagagtttttcaacatagtttggcaggcagggtgctagggaatgggtgccactgatttagttggggatgcaatcactggggcgtggaaaatggtccttgtgtgctgagtctacttctgggtggggactacaggaagagttgaatcatgagtctttggtctgagtgaagtcatctggttgtcagaaatgccaaagtctgaaaagacatctcaaaaggtcaatcttaggttctacaatagcgatgttatttacaggagtaattgaggaagttacgaaacttgtgacttctagaatgatgactgcttatcatttacgcctacatcttagctgaattctacccctttcataattctaaccttgtagcctttcattagttttacaaaggtggttaagctttgggaaggcttatatcatctttactgtaagattaaactagaaactaaatttctcctaaagttagcttggcccatgccctggaaagaccaagggcagtttggaggttaaaggcaagatagaattggttaggtcagatcttgttcactgctgtaattttctcactgttataatttttgccaaggcggtttcagtacttaaaataaaactgcatatagagctacaatttctctcagttgatttcttatttgctatgatttaatctttacatttaaaaataatatctattgagtcagtttcaaaaatatgttcaaaaagctgtgggtgtttaaaaatattttaaagtattatatcttttcttagtctttataggttatttactttgatttaaatgattactccatgtaattttcttgtatagatggttggtagaattatactgatttaaaacaaaacctgaatttaatggtagattattaaaagctaaagtattcttcaacctcacaaagtcaggaaatttacactctagatttccatggtaactaggatacttgctttacaatacaaaagactctcaaaggatcatgtaaggaaagaatacttacctaccattaaaaacatattcagaaataaacgttcttataatgaaccagaataggaaaaaaaaaggaaagcaaatgaataattcttctatttctaacttacattgtgtaataattttctatgggtatacaagttttattttatatatctattttatcctacactgaagaagtaatataataaagctcctatgttcttgaggttatgaggatgtgttagcagaactcttcagggatttgaagaacagtgatgctgtgctgcattctgtgcaagactaggaacatgacttgagtcacacagaccaggatctaaatcccattcctaatcactcaccaacagcctaaccttggacaactcttgtaacttctctaatcctcagtatttttgtctgtaaaatagagatattatgctgatttacagtgttgtacaattatgtatatacagtatatctaatgtcagccttataataggctctcaataactattaatttccttgtgctctcctttacctattaccccacttcttccatttaccagcccatttccacccgagggaccctaaggctcaaaattaggatgtgaccacagatggcaggtaggtggaactgaggaataaacttggttgggatagttcttcagatcatccctagcatgcagtatgctagtctaacgcagtaatgtccttcaagtgctctaataccttaaccactgaacagtgtctgtagatactcttagggggcttcagaaagccacttctatgacagctatactcctgtccctttaggaccttgaatcttcccaaatacaagtatttttttctaaagattttcttaaaattttcttaagacctttagtaaaagtgtattgtagctttatatttttctttattggagtgctacacatctaaatatattttataagctattccaaattaggttaatacagtgattgattactcctactggaaaaaatttgaaatttcagcctttgaggtagagaagattttgataaaatttattttgacaatttctttaaaatatcttgattcttaagcaggtttgtaatatattaggcctttttggtagcagtcctgtccttcaataacatcaccttcctaggttatgaacatctgtatatataagcacttggcctaaagcaggactttagagaacttagagaggtgtttctataattaactgaaatactgttacttgtgtgatagtatcattatttttatatttgaagctttactatttcaactgtactgtggatttacatagccatctgtgggctagctggggaactgataatgttttaaatattagttcagaaaatagattcagaattaccaaagattgacccatgtatcaacttttggataacaagacctctgtgagttgatggtgtcttcagatcgtcagggccagcctgctgtgtacctctgcaaggaggacaactaagaaaaagggaggtgataaagggaaagaaaaggagtaagtttcttcttttatctcttaaaattgtctgctgttactttttgaactcatagtgactttagaggggtttatttagataaacagcctcctctcccacacccttttttcttttagaaagaaagacattgtaaaaaggattagagaactttttatcatttgggaagaaaatgaaaagattagggaagaacatttatataattattataacttgaataatatgttttcattttataactgggtcagctcttacctgaacaatctcaaggatgtttattgtatattgtatcatttatttccacaagtctgtaggccatcaactaaagtaaaaatctttttattattcagatttttattgtggcatttatatttaaataatttctcctgtgtaacaattttcttcttgcaatcaaaataaaatgttgcatgattttacatataggccactgggtaaaacaaaacacatgcctcagatgtaaagaaaaacactttctgctcaattttagatttatgttgtacataaaaggtgcctcacatggcaaaaattttaattttagttgtataataaaattttaaggggcaacttgactcatagaatcatttggcagatattgaatgaacactggttagatattgtggaggtatggatctggagggagagtccagagatggatgtaaatattttcttcgtttagggagcataaactgaagttgagaagatagttacatataaaaaaattatcccagaatccttagaactggaagacccattcaaaccctggaagttagttgaataacgatcctaggagcttggtaatttgcctgcaaaatttgtccaccaggttagctgcatctctataccaatagtggcatgctttcatgctctgggattctgagttaagcatgagtaatgttctgtttgctagtagggtaggactatacctaactgacgtagaagaatcaggaaattaggagcaaacagcaaacttgattatagaatagaagtagcaacaggtatatggccagaatcagatacaaggacactatcttgagatccactaagtataagtcaagtaggcatgagactcaaaactgagtagtcagacaagaaggatagcagcaaggtctggtgcagcctaacttgctttaagaagttgtcctgtcacttatggcatattccaaccaccatatgagtgggctacctggacacagcccacttttgagctgttcaaaccaatctagatctcttttacttcatgatttctctatttgttctttggttacacctttccatgcccttaggattttaattcttcttggccaccactttgactccagcagagctctctgtcttagcagtgattttcttccctgattctgtgtggctgagtttacaccactgctgatgttattttcatctggctcacattggccttgctagcagaatagaatggctgggatattctgccattgctttggagaagtgtaagttgaccctatggtccttagacttggcttatgtaatgctaatgatagaaactgctactctggaaactgattgtgggaaactgcttgtggtaaactgcttgaaccagctgagaagcctaaaatggaactattgaccatacattcattggaccctttctgttcatcatgtagaattcaacctatttgcacttgtgttcccagaatctttcagagtgagacctgattgctgctgttttgatctgtttcttaagtgtccctaaaagatagagacccgagttcttttcctattcataacaccatattctttataacggatgtcctgaaaaagacaaattaccttatctgcccaaatataaaatacaattttagttcccagtcattcctcagaaaagagggaattgcctttatttgagtctttgagttattctcagattattagacattattttgagtgtaaaatgtaaaatattatttgaggaaaacatgttagcctaaaattaccattgtcagcattagtttgggctatttcccttgataaacccgtgatgtaatcaatcatgccctctcccctccatagaggttgggcctgggactcaaagtttcaaccctctaatcacaacattgattcccctggaaaccagtcctcatcttgaggctatgtaggtgcccccagccaccagtcaacttattagaatacaaaagatactcttatcactctagtgattccaaggattttaggatttatgtcagtaaatgagacaaagaccaaatacatatttcacaatattataaggacaaatgaagaaaacaactatctcaatattgaatggctttgcacaacagctcactgaatgcattctatttggatccaaaagtggctgggcatggtggctcatgcctgtactcccaacactttgggaggccgaggtgggcggatcacctaaggtcaggagttcaagaccagcctgaccaacatggtgaaaccctgtctctactaagaatacaaaaattagttaggcatagtggcacatgtctgtaatcccagctacttgggaggctgaggcaggagactcgcttcaacctgggaggcagaggttgcagtgagccgagatcatgccattgcacatcagcctgggcgacaagagcaaaactccatctcaaaaaagcaaaacaaaacaaaagaaagcaaaaaaacaaaagtgccatatctcacattagagggtaataatggtcatgtgttactatgtacaagagacatctagcagggagcctctcttggctgactcaagtctgaactgttgcgcctgatctgtacctcatcctacccttctcagctgtcttggccacttgctttgtttttgattaattcattatgctgtctatatccttcttaatttgatgcacatatttgatttcctggctaccttgatgaactttctgctgcattactgcctctctatccacagggcatctctggagtaccttggtaactccaatttctagactaactgagtctaccctgctgaaatcctttgagtttggagcctgaaagagaactgagaaacttttaccaaaggtagggttaccatgaagctaataaagcttaagttcagggttctacatctgcataggatcctgggatattctgggaatttagaatgttctagatggggagagacagccaggttatggtcaggaaggtcaggaaacatttctatataagcatttctgttcaaagagttctcagagaaggaatgtgagtctctaagcctccagaaatttatggtaatttcttttcgtgttctaagtaaatatttacttttgtacctaagttttcatttataatttggtattcttattttaagagatgaccactcaaattgtatatgcttcaggccacacaaaatctggatccaccactgggttttactaaatgagatgcttgggtgttttgctagttcttatttccctatacttagtaaaatataatttatacaacagtaagtagaatctagagcctccccaaatcattctaaaatcattgctttcgtggctcctttacaagagaactggaactgtcaccaaaccaaactagatctgtttgactgcacagatgagtttgccttcacacacaatgggaagccaagcactgaagcaccagatttttacactgagaaaggtttattgcaagtcgactgacaaggagacagaaggaaacgctcaaatctgtcttcccaagctgactggatcctgccatggagtcatgccaggacttgatctgattggatcctgaatcctgccatgcagtatccacctcttaattcagtccttactccttagtccaagcacttaggttctgcccatttggttcatcttcatgttcaggttatgtgaccttcaaactgggggtccaacagcaactgaaaaacagcccatagctttgttacataaaagtttaccagattggtctaatacagttccaaatcgcccctttattatgtccattcctcagtattgagggaaaaggggtgacaaccactctagctagttcctgctggttagatagtagaccttggttagagaaatgaaattgtttagtgctcaggattatgtttcagaagaagttacttcaacccagttctaggacaaaggaataaagagttagcaacctgaacattgtttgtttcagagaacaagggaaagaaatctcagattttatagcaaaagttcacacccaggttcccaatcagttctctttgtgcaaatgaaggattgaaacttgtaacttgcttagttctgattgattgatacagctcaactctgattgactggttcaagtgagccccaaaggttctatagattaaaatgtgtgagttttggaagaagagtatgtgtataacttgtagtcagcaaatggctacatggctctatttaaaatttaggctcagtcagctactcaggatccatcttgaaggactggctcaaacctgttggcagatagcattgcatcccatcatggtgccagagtggttgactacctgctccaggtccatctggtcccttgtagagatccttgaggcagggcagtggccaattgaacgactagagtcttttacttatgagaggcactcaaatgtgtgctaaatttgaaccaaagtctcttgggttaagttggttcctgtttccagctaaaatgagtttaaagtcttaaggattgagtcggcacaatcctagtgggagtcgcttgcagacagctgttaaaataggctagaacaattttaaagagcagccaaatgcttagcccaaatatgaggaggatcattaagacttgtagggtgaaacacagaaggaatcttataccagggttaagccagctgaaaacgtctggacattggaaattccacccaataagtccagccaggagtctttctgaaggtgtccctttcagagatttggctaacattataacctcagatgttcccaattcacctgagtggtagtatttacccagatacagcagcaagtattagcgatagcagaaacaccaccctgtgcagtgaggtgttaatctaaagcagtgtggttgtctaggatcacacaagcaagggagtctaggggaatctctgttgtgccctgatggcatgagtggtgaagcaggcagctctattaacagtgcagaaaagtttctgaccattccaaacagaacctagtccaaaccaggacctcagaaaccttcctgtgcagctccttcactagagttaatccctttcagcaaatcacatccatgagtggcctccaactataatccatggggtcattgtcagtgttggcgtgtgcctcaagactctcaggtagctcttggagagcaggaggcgtagaattagtgaaactgactgaatagatgggaatttgcataagatctgtctgtggccagatctcctggtgaggacaactcaagtattattttccccttttttgggagaaggatatgtgggcctgacaggtttctaagaagtcctttcccaggaggtgaatgggggctgaacagacaaaaacaaacaaacaaacaagccaaaaaaaacaatgtggtttctcctgactggatgaattcagaactccagagagagggtgttgaatgcccaccaaggttaaaaaagactaaggaaagggcctagggccaaggcaggctaaatgccactcgggtctttgttattgggcttttattattctgttggtctgttccaccaccccagtggatgttaataggccaaattttataaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctggtttccttgtgaggcagggagctaaataaaatcttgttgccatactttaaagggaccactcagcaatgggaagtggcccatggaggcatgcaacagtttgccagtagtgtattgtggacaaattttacacagataccaaagtcatgaacaaccgtgaaggcatacctgacatctttataaatactggctgttttacctttggctaaaagacatgacctagtaagtgcatgcagttccacttattaggcagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactccagcctgggcaacaagaataaaactccatctcaaaaaaaaaaagaagaagaaagaaagagaacctcatcatttgctagctggcttatgatgtgacttgaagagagccgtgacagagtatggaatggagatagtgagaggtagccccataactatcttctctatggcttttacaaggaagagacagcatcaactgctctgagacaaggggtcatagtatcctaaaggtctagtttgtccccaattctgatattacactagtaatatcagatttaaaaaggggaaatcccctgaatgtcctcagagcatccctagtctggattgtgaaaagagggctgagggactccattgggatttagttataaccaactattggaggaacttaggaagattcagttcaatctacagatagataacaaggacttgaagacagtgcacagagttacaatctaataacagatgtacttttgctttccttagaagcataactttttctctccacagtgatcatctaagaaatctcagatttagaatcttttgcagctgggaagccaaaccgaggcaggtttttggagtttacttacagtcttaaggttcttgggcctgccaggaagtgacagttttcattcactccctgaaaagctgggaactcctgaagccaggcattttattcacattcttaaatatgacatttcagtccaaaccttagtaatataaccaatgtttcccattgcatcttgcttataaagagagagcacatttttttttttttccctgagacggggtcttgctgtcttacccaggctggagtgcagtggcgagctcttgactcactgcagcctctgccccccaggtttaagcaattctcctgcctcagtctccagagtaactgggattacaggcatgtgccaccatgcctggctaattttttgtatttttttttttagtagagatggggtttcaccaagttggccaggctagtctgtgaactcctgacctcgtgatccaccctccttggcctcccagaatgctggaattacaggcgtgagccactgtgcccggctgagagagcagattttttactgaacttacattacataaaaataagaatactcattaatggtttctaaattttgtaggaatcaagttgtgagaaaaagcaaatgctcccacccttgttcacaaaggatatgttatcaaattattgcaaactctaaataacttatgacagaaaatttcctaagtctagaaaacaaaacatttaagtcataacaattaagttatgacttaacgattaagacttaaaaataaagtcttaacaattacttaacttcaagtagttttgtttttctcagtcttaattaataattttggactatagccaattgcaagtgcttccagagaaaaatttgagataataactgtggataacaaaaattcagaacagccacagtcaaagatctgatgagagtttgtaactaacaaagaaatctaggtatttcggtagcatataactaatttcacatcatgacatataccccaacatatccgaattttaggaatcttatacaattttggaataacttttaatagcacatttacacaaatatggcttaaaggaaattcaacagcattccttatttgacagtgcttcccatattatttaccaaataagcttaatcatttaaaatctctgtaagatgagagatgcaccctttgaggctctccagggggcccacctgtaaaatgtcaaagttaattttaggccaagaagcttgatttaggatttggatcctgggagaacctacgaaagacatcaaaaagttcaaagtacttccttcaacagaatcataggtcactgccaaatagtagttactcatttaaccagagtgacaatcaaaagacttcaaaagcaatacagaaagttacatgaatgtaaaaaccttaactcttttaaacctcagtcttcctaagcaatctttgtttcctaggccagttactttgagcaggggaatacatttagtaacagcataggaagtcctggttacatgaaataattcagacatttaaggcctggttacatgaaacagtgcagacatataaaactacagaaccaatttatactgggataaaatattgcttttctagaccttcaagataaatctgaaaccagagaaactagacagttctcaggaagaaatggggcagaaagagaaacttatttgtaattcagagaatggctattaaagaaacagacttcagaattaaaaatcaaaacctcttgcaatcttaccaggagcaaattgatgtcttaagacactcttgttattttaacatagagggccaaaattataagttctgtgctttaatatcaacattcactgcctagaaagactttttaaaatttcttttaattatagccaacttattcacaccccaagtttctttcttaaaatttctatttattaaccttttcatgacttactcagaccatctatgacatgcttagactttctacctttccctataattctctttcttaaataaccagtcattttactttaggacaaagatttactacacatgattctttcttatacaatattattctcttttctttatatccataactttcttacgtctctctccccttactattagttcctttttatcttgtttctgtttcctttctaaatccatattgtgaagcttcttttaaataacctccaaatttgacaaaataatttttttctcactgaagaacatattttatgtgtttcttataattttttcttattaaaaacacacctggccaggtgcagtgcctgacgcctgtaatcccaacagtttgggaggccgaggcaggcatatcacgaggttaggagttcaagagcaacctgagcaagatggtgaatccccatctctactaaaagtacaaaaattagctgggcatggtggtgggtgcctgaaatctcagctactcaggaggctgagaccggagaattgcttgaacctgggaggcggaggttgcagtgagctgagattgcgccgctgcactccagcctgggcgacagagcaagactctgtctcaaacaaacaaacaatcaaacaagaaacaccttttggcacagttcatttgaagaattataaattagaatttttaactcttagtaaccttaaattttattaaaaacatagaaatcttgctgggtgtggtggcttacacctgtaatcccagcactttgggaggccaaggtaggcatatcacctgagatcaggagtttgagaccagcccggccaacatggtgaaaccctgtctctactaaaaatagaaaaacattagccaattgtgatggcgggcacctgtcatcccagctactggggaggcaagaggatggtttgaacctgggagacgaggttgcagtgagccaagattgtgccactgcactccagcctgggcgacagagtgagactccgtctaaaaaacaaacaaacaaacaaacaaaaataaacatagaaatcttgaattgcctattgcatatcagtcttttataaataagaaccattttataattattagaaaaacatgttttcctatagcataatttttagagaccaaacatatttagtctttctattaaatttaagaagtcaaggagagacctaattttggtcctttcatggccaccattttgtcaccaaaccaattgggtcagtttgcctgtgcacaatggaaatccaaacaccagagcaccaggattttacattgagaaaggtttattgtgagtcagctaacaaggagacagaaggaaatgctcaaatccatctccctgaactgggggctggtcagcttttataagcatagggtaatgaggtgtgatcttattatatcttgcaacgaggtgatgccaggaagcatgatctgattggatcctgccatggggtatgccagggctcaatctgattggattctggatcctgccatgtggtgtccacctcctaattcagtacttacttctcagtctgagcactagattctgtgtggtcatttgcttggtttatcagcaagcctttatagaaagcctactatgtgtgatgaaggtactggcccaggtgtttttcaggtacattaaattcaattcagagtcatttgaaatgaattgccttaactgtgaagtattttttgttccttggaaccttaatagcagttcttttttttttttttttttctctgagacagagtcttgctgtcacccagggtggaatgcagtggcgcagccttggtttgctgcaacctctgcctgttgggttcaagagattctcatgcctcagcttcccaagtagctgggactacagacacccaccaccaggcccagctaattgttgtatttttagcagagacagggtttcaccatgttggctaggctggtctcaaactcctgacctcaagtgatacgtgtgccttggcctcccaaagtgctgggattacaggcatgagccaccacacctggccaatagcagttttctttaaagaaataagaaattgaaagtaacatgataaatatgagtaagtgccagggaaaaacaatgataaattattggcaccagtcatttgatgttctctgaaacccagagacgtgtcagtctgccggtgctaggagttttagtgccaagaatgtaaaaggaaaatgatccttcatcttttggggtaagttttgtcaacctgaagtaatcaaaaggatcagaatccagttttaaagagtttattaacgtgaaaggctaggaacggccatccaggaaacacagactccagagaaatggagtcagcactctgaagttaaaagttaaggtcttgcatataggaagaaaacaaagaaatttaacaggatcacaacattttctatataagactgatttatgagttataacaatttagttacagttcgttttctttttccctatggcttgttttctttacagctggttttcatttcctttccaatttaagaatatatttaatattctatcttaagacaatgtgatagtcatgaagtcatgaagtctttgtatgagaaaggttaagagggaagttaatgtataaggaaaatcaacagagaagagggaaggaaccttccctgacaccctttattcattttacaaaacattgaaacattgtaggtaaggaagaaggctaatctgtaatcagagaaacagagttatagctttctaggttacatttgcctgtcatgtgactcaggcctcatgatcacatttctttaagggctcaaaataatgtaaagctccagcagcttagattttcaattattttatttcacagtttcatagatggaggtcatgggtagtctcggggtaactatttttcaagccaaagaaccctgtattgagaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaagctgagctctgcctcctgtcagatcagcagtggcattagattctcatatgagcacggaccctattgtgagggatctaggttgcacactccttgtgaaaatctaatgataaatgtaaatcgcttgaatcatcctgaaactgtcccctgctcccatccatggaaaaattgtcttccacaaaatggtccctggtgccaaaaaggttgtggactgctgtagtaagggatacctgtagttttcttcacagcacttattacttcctgatttgtttgtctgtctatctgtctatctatctttctgcatgtctccttcactaaattgtcagttccatcatggttgtgattttattatgtttattgctctattaccatcacctggaacaatggctggcacccagtcaattctcaattcatgtgtgttgaatagatgtgttgacatatgaatgaatctgtttgacccaatatcatctacactttttattttaaaagtatgattataggccaggcacggtgactcatgcctgtaatcccagcactttgggagaccaaagtgggaggatcacttgagcctaggagtttaagaccagcttggcaacatggcgaaaccctgtctctacaaaaaatacaaaaattgaccaggcatggtggcacacgtctatagtcccagctattagggaggctgaggtgggaggatcacttcagcccaggaggttgaggttgtagtgagctgtgagcatgccactgcattccagcctgggtgatagagcgagaccctgtcacaaaaatgaataaataaataaataagtaaaagcatgattatatggaaaggacatattacatgttattaagttttaaggagcacaatatgaaattatatacagtttccacttaggtttaaaaaaatcaagtctttgcatgtgttcatttagccattcattccttgaaagaaaacgtcttgagcgtctcctgttaccgttttataggaagacagatcatgaaacaacagtaaatgaatgataaccttctcttcactcactgctctctagccatattgatctttcaatttctcaaagttagcaagctcttttctgtgcacattttactgtcttcacagggcttcttgtattataaagctggtgattatgtatttatgaggatagttatctgcctgatatctctgtctctgtattgtaacttctgtgagggcaggaatcatgataccatttaatcgtcaatacctagctcaatgcccaatacatagtaggtattcagtaaacatttcttgggcaaatgaatgaacaggtgattaggggaagtatgtagtagaaacactttaatgagagttagtggagctttccccaaagaaatgaattttaagctgggatctgaagaatgaggagaaattaggaagtgaagaagaacaggcagagtgttctggagcttaagcttagatattatcctaaaggcaagagaagagttttaaacaaaatgtagcactatcaaacttccatttttcagtgttgttaggaacagactagataggcagtgctggagccagagaggctggttgggaggctttaataataacagatggtggtggcctcacttgggttcttggcagtggagaaagagagaagtgggtgtgtttgagagatttttagaaggcagaataactgattggggatagtgaaggaaaaggaagagttattgtcattccacgtttctgctttacaattgagaagatccttgggccattaatagagactagggactcagaaggaagaagtatctgaggagtaaagaacctgaggtacccttgagacctatctaaatgaaggctgagcagtaaggacttggttatataggtgaatattctgggtataaataaatgccttgaaagaaagaatcaaaatgttaataatattgggactcaagttatattaaattttttattattaagttttgggtttcattattagtgtatttttgtgaaggaaatataataaacttaaaaaaattatattagcatgggaaatgcaaaatttaaaaaaaggtgacaaaaagctaatatcttctttaggcaaaatgtgggctacacccagtaaaaataagtgaatggtcctgaatagaagcctactgagaagtgagttcaacattaacgtgtgtgtatgcggatgagtcatctggaaatttaaacttgccattcaaagaaggcctcctagtggaagggcctgtcatttattcatccatgtatccttaggactcagcacagtgccttgtacctagcaatggctcaagcgatagctatgattttatatttgttattaacacattaattttgtttacatcactattcaacattgaatttttatacaatgatataatctatgtcatctttttaggtagattggggtcaactggactacttagttgtagacatgccaccaggaactggagatgtgcagttatcagtctcacagaatattcctataacaggtaaatcttcaaagtttaaagtaatttgtactttttttgatgtgttgttattgctataccaaaaaacaaactccatgttaggcaaatattttgccttaaaaatattcattcacttataaatttttcattagagatcagaagcataaattattcaaaatattaccagaataagtatatttataaaaccatgagacttttgttactaggaagagtgaagtctgtggttcttgttcttgggagaaagaatttgtccaagagacaattttagcaaaaagaacagagaatttattgaagaaagtacatgccaagaaaggagcaggctggaaaaacagcagtagtagcagcaagggttcagtagtagcagcaagggttaagtagtagcagagacagtatgctctgaaagaggaggcagaatgggctgctggaaagaaaatgagccagcagccctgagagttcaacattgcagttttcattgtgttggactctttctttaagttcctgcctgtctcaagtctctgccattgtctttggctagtttcccacttctgctttaagtccctaccttgtccctgactagttcttgccacagttttgtaggattctcttactctgagttgatgcacatgtgtgtgcccagtgttggatatgaagtctacttaatggcattgttgctccttaccgccaccccaggaaggtggtaaagtggttaaatctgtacttactgtgcctgtgtatctcttaggaatttcccctttgccctctttctcttcatatcagcatgtacctagctacattctgacaggttaactgtagagtgagcaattactgggcatcttaaggggtatttcaggatgttcctttctgcataggtatttcccctcctctctgttcatacctagcatgcaggttttgggtagtctctgggatgtgagattttctagtcctccttttctcaggggctctctctcctgctcatgtctagctatctgtctgctctaacacttcacagaggtggtagtataaatctgtgttctagaaaagcagtagcatttaagtattttttaggcagaacatgactggttcactgctgtgcagcatttatactactggtacatgacaggcactcggtaaatatttattgagtgaacactggataagaataaatattaggggctgagtgcagtggctcacgcctgtaatcccagcaccttgggaggccgaggtgggtggatcatgaggtcaggagatcgagaccatcctggctaacatggtgaaaccacatctctactgaaaatacaaaaagttagccaggtgtggtggcgggcacctgtagtcccagctactcgggaggctgaggcaggagaatgacgtgaacccaggaggcagagcttgtagtgagctgagatagtgccattgcgctccagcctgggcgacagagtgagactcttgtctcaaaagaaaaaaaataaataaataaaaataaatattaggaaaattggctttttggtaaatacaactatgggagaattttatagtctgctaattaatattaaagtcaagaaagcaataaacatagcttatatcaaatacatactacttcaatatggtaatgcatatctgttttatgatacgaaatttaaatattagtacagtagttaccctttattttgaatctgtttctgaagattttcctagattccactaaagaatagttgcaaatctataaataaaagatttctgggaaaataatggaattttaaagtatctttgctaattagttatatactgattaccaaacaatatcattgatatttaatgatcaaaagtttagaatctaagtttttgacaaaatatacgtgttgtttggaaatatcagtatagcctcattaatagagatacttttgctgttttaacatatttgtaatcttaattgagtctgagactttttctttgataaggcaggctgtaaaatatgagatgggagtaaaatgatatatgaaaataattcattttttcatactgtgatttttcttttttttttttgtctttttcctttttaaggtatttatagttttaggatcttttatatttacaaattttaagaatatttaccaaatgttcattttaaaaaaatgtgcttctgataccttggaatgccttttgcaagcatacaaaatacttgcattattcatatagataatacattagtaaaattgggctaaattctcatttatgtcttgagtagtgacttggcaccttgaaaaagtttaatttacctcacacagataaactgatgttgcctaagcagtttttttctccacttacttttctttaagcccctttggacaagatttatgattaaattaccctattttagtttgtatttatactctaacaccagcattgcatatagatagaggttgagattttcttccccattctttcttacatcctaacatttaaccagtatatttcctttttcctttcctctgatgaagagtctgccatgtaataggcagttaatattacatgagagtaagacatagtcttttttttgttgtggtggtgaaatgtgcagagcagttaagtagtactaataatatattggcattgttgtgcagccatcactactgtccatcaccagagccttcatcttctcaaactgaaactctggagctattaaacagtaactctctggccggatgtggtggctcatgcctgtaatcccagcactttgggaggctgaggcaggcagatcacgaggtcaggagatcgagaccatcctggctaacatggtgaaaccccatctctactaaaaatgcaaaaaattagcctggtgtggtggcaggcacctgtagtcccagctacttgggaggctgagacaggagaatggcatgaagctgggaggtggagcttgcagtgagccgagatcgcgccactgcactccagcctgggcgacaaagtgagactgtcttaaaaaacaaaaaaacaaaaaacagtaactctcaatggatcctccattctccccagcccctgataaccactattcttaatttattttttacattaaaggaagaccaagcaagaaaatatattttgaaagattgcattaatgccagatgtagtggctcatgcctgtaatcccagcactttaggaggccgaggcaggaggatcacttgagcccaggagttcaagaccatcctgggcaatatagtgagaccctatctgtacaaaagaatattaaacaaaaaaagttagctgggagtggtgacgtgcacttgtggtcccagctacttaggaggccgaggcaggaagatcacttgagccctggaggtcgaggatgcagtgagctgtgttcatgctattgcactccaaactgggtgatagaataagaccctgtctcaaaaataaataaaaatgaaaaaagatttaaacaaacctaaaatttattttatgatttattaataaaccattatatcaataaattttgattcatatgcaaggtaaatgcctagcactatagagaagaaaaggataagtaagtctattccctagacaagagttccttaccttttttgactttcaaagtttttatgagaatttgatgaaaactctggattttctccaggaaaatatatttatatatggtatacagaaacactaattttgtatataaatttaggaagtttacactcctcaggttaaaagccccagctctaagagatagagcatggtgaggagcaggagagagtggctggtaagaaaaggacatgtatgactgtaatccacagtatgagaagtgcttatgagacatctaaacccaggctatggggtttcaaaggaagagaatgtgagattaaggggaatacgaaacacttcatggaagtggaccttgaagaataaatatgatacattgtagaacattcaggattgctccataccttgctttctttgcttgttctttaataatttaatcaataaaaagcactaattctttatggacagtagatttctgtatgaaatggtaccgcggcgattgcctgttaataataaactgccattggatgacagtcttccatatattaattttcaaatttaattcttacaggtgttatatgatttctattttcttaaatctcagaagggtttagtggctttcataagataacacaattacagtagatcatagctaagtttcatattcattttgacagagtttaaagcttatgctgttgacctctatatcaaactggcctaatgtaaaacccaacaatatttgactcattaatttttctgagtttagccctaatccattaaaattcacttaggttgaaattattctaatctaggtaatccctgataaaaaaataaatttatctgtgaatatgcctaaatttgtgcaccccgatgggatgaatatccaactcgttatctggattggtgcttactacattcagtaatttttttgagtcctgaaagactactttgggcctctttaactcacacattccaggagaattctggaagtagtctagaagcagttttcttcatcttttaggagtatagccccaagtgattcttgaagagaccagtattatctttgtgctgattcatatgccttgaacatatggcccattttcagacaccctggctgtctgtatagagttgtagcaggcagtgttagtacattcatgttgtggttattaagtcagtattaaaatggataacaatgaaagactagatttcctacactgaagttgtattaatttgaattaattttataattataaaaaatagcagcaaggaaatgcagataaacaaaaaaagaaaaaaaaagtagcaaacaataaaaatgtcctaccaaaaaggatgttgaagggaatttggggagcatgtgattgtgtctatgtgtgtgttaaagccttagttcctgaggtttgggtttattcaggccagtgtcatttcacagatagcatatctaaaaaggtaccaaaaatgattcagctcccaagatttagagggaatggcaccaaccaaagaattgctggcctggctgaatcatgactttcataaatttacagaacctgtaacagcctgtcaaaatcatgtctgctctttcagacttagctaaattgtatgttctctaattataaacccagtttttctttccttatcattgactttagaactcttttaagatactctgtgttcttctcccttttcttatgtcccatatcccataaacaacataagctctttagattctcatttgaatatccttgtaatttgatctctctctccttcccagtaaacaccttcatataatttgggatccctctagaaaaaaaccctttgtactcactactcccaccttccttttactttccagaatatgtctttacagcacagttgatcctcacttagaatgcctttcctccccagtcagtgagtactcaaatcctgtgtaatctttaaaagctatttagctcaaatgtctactccccgccatcttccccaaacccgcatttaggaatcacttccccctctttggaaatcacatagcataatatttggattattcctatagcacttctgatgttcttcattcaaaacctgcatacctatgttatcttctccagcagactgttaacttcctggagggctaggctgtttttctttcatctttgcatttctcagggtgccaaactcagtgcctttctgcagctactcaggaaatgttgaatcaatgaatgagtgttttatctgtgactgtattatctttccaactaggctggaagctgcttgaatgcaaaaattttttcctatttatcatagtatcttttaaagtaccttggcctatagcttatgcaattaatattaactgagtcaatgacaaagctagtctgactagctattactgtttatgtagaaggatttgtgcccccttatctttcttttttttttttatttttttttttattttttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggtggaactagtttacagtcccaccaacagtgtaaaagtgttcctatttctccgcatcctctccagcacctgttgtttcctgactttttaatgattgccattctaactggtgtgagatggtatctcatagcggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttttgaggcctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctcagactttgctgaagttgcttatcagcttaaggagattttgggctgagacgagggggttttctagataaacaatcatgtcgtctgcaaacagggacaatttgacttcctcttttcctaattgaataccctttatttccttctcctgcctgattgccctggccagaacttccaacactatgttgaataggattggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaaaggtaccagttcctccttgtacctctggtagaattcagctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttccagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctttttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattacgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgctatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgttgtgcccccttatctttcttaccatcctgctgattcattcctatgagtgcctcaccctgactgcttctcacccaagtgttttttctgtgtatatgttaaaggaagcatttttcaaggaaacgtgcattttattttatttcccctctgagagaaaactactttcattttaggtatttatttatggttttttttttttttttttgctgtgctgtatataatatccatgtggtcagttgatgccttttagtattccctttgttttagtgtgtgggatagtagtgtgcatgtgggcatttgctatttgattacttgcaggctctatattaaattactaatgagaataattagtattgttccattgtaatacagtaattagaaattatcttatttatgccaggtgcggtggctcacgcctgtaatcccagcactttgagaggccgaggcgggtggatcatggggtcgggagaacgagaccatcctggctaacacggtgaaaccctgtctctactaaaaaaacaaaaaattagccgggcatagtggcgggcgcctgtagtcctggctactcgggaggctgaggcaggagaatggcgtgaacctgggaggcggagcttgcagtgagcggagatcatgccactgcactccagcctgggtgacagagcaagactccgtctcaaaaaaaaaaaaaaaaaaaaaaaaaagaaattatcttatttacttgaagtgttgtttagtaaggtgctaaatacctttctaattctctctccttacctgtggaaaacttgcttaactccacagacttgtaaggatcaaataagataatgaatgtaaagcctccatctaaatgtatagtattttctagaaactacaggaacactatcaaaaagtttttttgtgggacagggcagttagtagagaaatgttgtgaattagaaagagcctttctatcaattttgcatttctataagctatgttgagaataaaatcagatgttttatacttgggaagagacaatcttttggaaaatatgtagaggcagacctgtccatacagaaagtgcagtattctgagagagaattttgatattagctagatacaagatacaaccacccccacacacacaaaaaaatccttttttatagtgtacatgtagtttctagaaaatactatacatttggatggaatatttacattcattatcttatttgatccttacaagtctgtggagttaagttctccacaagtaagggtagataatcagaaagatatttagtaccttactaaacatccctgcaagaaataaggtaatttcttaattagcaactctttgtatatgctccatcttgttacataaaatggataacaacctcattacaggtacaccttgggaatattacaggtttggttccaggccacctcaataaagcaagtatcgtaatcaagcaagttgcatgaactttttggtttctcagtacatacaaaacttacatttacactatacagtagtctgtgaagtgtatacaacattatgtctttaaaaatatacattccttaaatattttattgctaaaaatgctaacagtcattcaagcctttatcaggtcatgctctttttgctggcagagtgtctttccttcgtgattgtggccactgagtgatcagggtggcagttgctgacggttggagtggctgcgacattttcttaaaataagacaacaaagaagtttgctgcatcaactgactcttcctttcaggaaagatagcatgtgatgctgtttgatagcatttaacccatagtagaatatctttcaaaattgtcttcagtcttctcaagccatgcttctgttttatcaactaagtgtgtgtaatattctaaatcctttgttgtcatttcaacagtgttcacagtatcatcaccagaagtagattccatctcagtaaaccactttctttgctaattcataaggagcaattccttatctgttcaggtttgataatgagatttcagcaattcaatcacatcttcagatcccacttctaattctaataattctcttgctgtttccaccacatctgcagttatttcctccactgaaatcttgaacccccaaaagtcatctgtgagggctggaatcaacttcttccaaactcctgttcatcttgatattttgacccctgcccatgaatcacaaatgttatttggtacagtgagaatacatacaacataatatcgattaggattgccatcctattatatgggtgtggtttgtggcaccccacaacaattataatagtaacatcaaagatcactgatcacagatcaccataacagatataaccttaatgaaaaagtttgaaatattgcaagaattaccaaaatgtgacacacaaccacaaaatgtgtctatgctgttggaaaaatggcacgggtagacttgcttgacacaggtttgctacaaaccttcaatttgtaaaaaatgcagcatctttgaagtgcagtaaagtgaagtgcaataaaatgaggtatgaccatgtaagaagaaactttaaattaaaaaagaacttcttacttgtgttaaatatttttccttctttgtttcaactgaagtgctgtgtatgatatctgaagactgtctcaatttgacttcaactcttggaattaagtaaagacttcatgcttcatatgaaatatgtgaagcatgttttctctttttaaggattggagagttttagtaatttatttatattaaagtgctgtattagtcagagtcctagcaggaaacagacggcaaaccttaaaatgaattaataaaacaaagtttaatgaagcaactagttacaaaggagtgagcagcattaaggaaaccaaccagagatggtgacatacctagggactagtgacagtacaagttgttattgcccttccactggaaagggcaagggagtgaactgtcttagtggaacttggagcctgctggagccatggaaaaggggctgcctgatagaagaagctatggctcttgccagaactgctacaaggcaggaaggagtggtgggtgaggtaggtaataaaacttcaaattctttctcctcccacagtctcatctccttttgtccctcctgatagtggatccccattgagagccagaaggcaaggaaacttaggtgatacagtccacagaggtcaactcttgggggactgatcagggcagagggcatttgggcagagtttgaggggcacagagggagactacagcaagtggaataactaacacaacattgctccttcatggttataattgtgaattaacagcttgagatagatgaagtacaaagaaagaggacagaatttctgccctctaaaagattgtaagctaatttagacaccagtagtacagtcaaattagtgaaaattgatactgtcacaaagcaaaattatactgtcattaaacctacaaacagaatatttatgttgtagatgagcagtgatgcaagcatattttgtgtaatggggagtaatagatggaagagtttattttgataggttagttagaaaaaagttccccttcactttattaagtaaagattgatataggaatgaaacttttggaaattgttcttataatagaagggacaaagactgagcaactgagagggaagctatcatgatcccttctttgttccctctgtgttcttccagggaacagcagaagtggtacaggacacagctagacagtcctagtgtaaatcctgttttgatttcttatctcctggagagagagaagccactgtgtatgacagtagtcagctagttaatatgttgaatattcatgggctcaagaaaagttgccctaacagtttggtgtgataccattgctgtggtttgactgtgtcccacaaaagttcatgtgttagaaacttatttgctaatgtaacattattaataggtggggactttaagaagtgattgggtcatcagggctctatcctcatgaataaacgaatgcccttatcccaggaatgagttaattctcaagggagttaattagttcttacaggagggagggagttctctccagagcaggttgtaatataataaaaacaagtttaacttattcttaagatctccttagcacacgatttacttgcccttcttcttcttcttcttctttttttttttgacagagtcttgctctgtcaccaggctggagtgcagtgacatgatcttggctcactgcagtctctgcctcctgggttcaagcaattctcctgcctcagcctcctgagtagctgggactacaggcgcgtgccaccatgcctggctaatttttttgtatttttagtagagaccgggtttcaccatgttggccaggatggtcttgatctcctgacctcgtgatccacccacctgggcctcccaaagtgctgggattacaggcgtgagccaccgtacctggccgcccttcttttctacacaatgtcatgacgtagtgggaaggctctccccagaagttgctgccatgcccttggacttcccagtctacagagcaatgagccaaataaacttattttccttataaattaattacccagtctcagatattgtgttatggcaaaagaaaatgaaataagacaattgataatgaggtgatgtcctttctacctgtctaggacctttcctatctgggccctgctgatagaaggaaagccagaggtctttctgtctctcattcatttaaatgagatgagataggagttttaaattaagacattgtaatatttcagtcattgtttaaagtgaaaggcatttattgtttgtgaaaggtgtcaggcctattgtcacagtgactaaacttccattcactcatcaaaaattcttgagaaaaagttaaacttgcctaccctgatatttttccttccatcagcagtttacttaatcagttatctcttttatggtaaccctctttgactgtcagtttggacaatggtttctgtaatgaagaaacctattggggattggaggatcagacagaaacttattgttgccaagttaaataaatgaatgacccatgcaccattactttaaatagtttccttgattgtttggcatttactcttccaaagcaaaaggaacatagtaatttcacttaggtaaactaaataaaatcttttatttttttaaataactattttttcacttcctattttcaaatttgctagagtagttccttaaaggcatctaatgccagtgttttggaaaacattgaaaattcaaagaaaaacatttggctattttggattttagtgctgtgtttcccctaaaactttgtaatttataatgacctcaaaatgtagctctaaaaataactttgcaccttaaaggttcaggaattaggacattacgtttcctaatattaaggaatattaaatcttcattaatgttttcagtttccagaacagcacgttaaaggaggcaatcaattttggacttttttcaagcacaccgtctttccatgcaaatgttgggcagagttgtaattaatagatacttggcaagagttgcatgatgtagaaagagttattgttgtattcatcaagttaaaaaattctttctgaaataaattggttttgttgttacacaaattgtaaccaactactagaaactgcattccagggtttcatcttttaagacattcctggaaattcagtttgaaacttcagccctggttagattgggaatcaaatttataaaatcaaatataatgccatttactaaatgctttctatctttcttttcttttcctccttcctttcgtttctttctttgggatggagtctctctatattgcacaggctggtctcaaactccctggttcaagggattctcccaccttagcctcccaagtaactgggattacagggatgcaccaccacacctaactctcaatctaaatttaagaagaaataaactctttagggctcttgtatttggctgaacatatatgaaatacaaaggaagggacataatttctgccctctatgagtttgtaagctaatatagacactagtagtacagtcaaattagtgaaaattcatactatcacaaggcaaaatggtactgtcattaaatctatgaacagaatatttatattgtagataacgaagtatattttaagtagtggggagtagaagtaataggtagatgttacagtatatcagttaacagttcaaaaaatagcttgagaattaataacttctgaagtatgacatgaaaaggagcaggattttaaaagcttccccagatgattcttatttaatcagctttcagaatcacttgtctagaccaacccatctgatgtttgaattccctgaatacctatcaagaggtcatctagcctgtatttgaataggaagtttctgagatagttcattcagttttgtcgtttaagaattctggtgcaaaaacaggcacatagaccaatggaacataatagagagcccagaagtaaggccgcacatctatgaccatttgatcttcaataaggctgacaaaaaacaagcaatggggaaaagacttcctatttaatcaatgttgctgggataactggctatccataagcagaagattgaagctggaaccctcccttacaccatatacaaaaatcaactcaagatgggttaaagacttaaatgtaaaacccaaaactatcaaaaccctggaagacaacctagcaataccatcctggacataggaatggcaaagatttcatgacaaagatgctaacagcaatcacaacaaaagcaaaaattggcaaaagggatctaattaaaattaagagcttctgtccagcaaaaataaactatcaacagagtaaacagacagcctacagaatgggagaaaatattcacaaactatgcatctgaaaaggtctaatatccagcatctatttacaagacaaaaaaaaacattaaaaagtgggcaaaggacacgaacagacacttttcaaaagaaggcatgcatgcagccaacaagcatatgaataaaagctcaacatcactgatcactagagaaatgcaaatcaaaaccacaatgagatatcatctcacaccagtcagaatggctgttattaatacaaagtcgaaaaataacagatgctgatgagattgcagagaaaagggaacacttatacactgttggtgagagtgtaaattagctcaaccattgtggaaagcagtatggtgattcctcaaagagctaaagacagaactatcattcaacctagcagtcccattactgggagtatacctgaaggaatgtgaatcattctgtcataaagacacatgcacgtgtacatttgttgcactactactcacaatagcaaagatatggaatcaacctaaatgcctatcaatggtagactgaataaagaaaatatgctatatacacaccatggaatactgtgcatccataaaaaaagaatgttcctttgcggggacatggatggagctggaggccattatccttaactacctaatgcaggaataaaaaaacaccccatgttctcacttataagtgggaagtaataatgagaacacatggacacaaagaggggaacaacacactggggcctctcagagggtgaagggtgggaggaaggagaggagctgaaaaaaagtaactattgggtattaggcttaatacgtgggtgatgaaataatctgtacaacaaacccccatgacacaggtttacctatataacaaaacttcacatgtaaccccgaacctaaaataaaaattaaaaaattttggggggcatttccttcatgatatgccagacagataaaattccttaatgtcttaaagttcagtgaagagtataatgaccaatatgtggtcaggttcttactaaaaaccacttttaaattcattaaacatttatatgtagaaaaaaatacaaatcccacagtttaaaaagttgtgcacttggtcatagatgttagaaatttgatcaggatctgaaatgtagctctgaagaatgccttcacatcttaagtatgacagtatttggaaatagatcaaagctttccatataaagtctctgtctctattcctttatttcctgaaaaatacctggttaaataaagttagggtaatggtaatcagagagcagcagttctcctctctggagttttttttagagaaagaatatgtataaaaaggaatgtgttctgttattaaaaggtctttggtattggtttgctgcagtcatgagcaagctgagctatatgtgcatcacaatttaaaatgcaaaatatttaaccttagagttcaacatgaacaaacactggaaaccaaaatagttttttcagttgtagagccatatgtgtacaagtaagctccccaaggtgtttgctgatcagtataaagatagattcaagactggaaaaatacaagggttttatcttttcttttttctgttttatttattttattatttttttgaaggatttttcttattatactttaagttctagggtacatgtgcacaacgtgcaggtttgttacatatgtgtatacatgtgccgtgttggttagctgcacccattaactcgtcatttacattaggtatttctactactgctatccctctcccatccccccacaccacgacaggcccaggtatgtgatgttccccaccctgtgtccaagtgttctcattgttcaattcccacctatcagtgagaacatgcagtgtttggttttctgtccttgtgatagtttgctctgaatgatggtttctagtttcatccatgtcgctacacaggacatgaactcatccttttttatggctgcatagtattccatggtgtatatgtgccacattttcttaatccagtctatcactgatggacatttgggttggttccaagtctttgctattgtgaatagtgccacaataaacatatgtgtgcatgtgtctttatagcagcatgctttataatcctttgggtatatacccagtaatgggatggctgggtcaaatggtgtttctagttttagatccttgaggaatcgccacactgtcttccacaatggttgaactagtttacattcccaccaacagtgtaaaagcattcctgtttctctacatactccccagcatctgttgtttcctgactttttaatgattgccattctaactggtgtgaggtggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgttttttccttgaaaattggcttacgttctttgtagattctggatattagccctttgtcagatgagtagattgcaaaaattttctcccattctgtaggttgcctgttcactctgatggtagtttcttttgctgtgcagaagctctttagtttaattagatcccatttgtcaatttttccttttgttgccattgcttttggtgttttagtcatgaagtccttacctgtgcttatgtcctcaatggcgttgcctaggttttcttctagggtttttatggttttaggtctaacatttaagtctttaatccatcttgaattaatttttgtataaggtgtaaggaagggatccagtttcagctttgtacatatggctagccagttttcccagcaccatttattaaatagggaatcctttccccatttcttgtttttgttaggtttgtcaaagatcagatggttgtagatgtgtggtattatttctgagggctctgttctgttccattgatctatatctctgttttggtaccagtaccatgctgtgttggttactgtatccttgtactacagtttgaagtcaggtggcgtgatgcctccaacttcgttcttttggcttaggattgacttggcgatgcggactcttttttggtttcatatgaacttgaaagtagttttttccagttctgtgaagaaagtcattggtagcttgatggggatggcattgaatctataaattcccttgggcagtatggccattttcacgatattgattcttcctatccatgagcatggaatgttcttccatttgtttgtatcctcttttatttcattgagcagtggtttgtagttctccttgaagaggtccttcacatcccttgtcagtgggattcctagatattttattctctttgtagcaattgtgaatgggattcactcacgatttggctctctgtctgttatttgtgtatacgaatgcttgtgatttttgcacattgattttgtatcctgagactttgctgaagttgcttatcagcttaaggagattttgggctgagacgatggggttttctagatatacaatcatgtcatctgcaaacagggacaactggacttcctcttttcctaattgaatacccttcatttctttctcttgcctgattgccctggccagaacttccaacactgttgaataggagtggcgagagagggtatccctgtcttgtgccagttttcaaagggaatgcttccagtttttgcccattcagtatgatactggctgtgggtttgtcataaatagctcttattattttgagatattttccatcaataccaaatttattgagagtttttagcatgaagggctgttgaattttgtcaaaggccttttctgcatctattgagataatgatgtggtttttctctttcgttctgtttatgtgatggattacgtttattgatttgcatatgttggaccagccttgtatcccagggatgaatccaacttgatcatggtggataagctttttgatgtgctgctggattcggtttgccagtattttattgaggatttttgcatcgatgttcatcagggatattggtctaaaattctctttttttgttttgtctctgccaggttttggtatcaggatgatgctggcctcataaaatgagttagggaggattccctctttttcttctgatgggaatagtttcagaaggaatggtaccagctcctctttgtacttctgatagaattcggctgtgaatctgtctggtcctggacatttttcggttggtaggctattaattattgcctcaatttcagagcctgttactcgctattcagagattcagcttcttcctggtttagtcttaggagggtgtatgtgttcaggaatttatccatttcttctagactttctagtttatttctgtagaggtgtttatagtattctctgatggtagtttgtatttctatgggattggtggtgatatcacctttatcattttttattgtgtctttttgattcttctctcttttcttctttattagtcttgctagcagtctgtcaattttgttgatcttttcaaaaaaccagctcctggattcattgattttttgaagggttttttgtgtctctatttccttcagttctgctctgatcttagttatttcttgccttctgctagtttttgaatgtgtttgctcttgcttctctagttcttttaatcgtgatgttagggtgtcaattttagatcttccctgctttctcttgtgggcatttagttctataaatttccctctacacactgctttaaatgtgtcccagagattctggtacgttatgtctttgttctcattggtttcaaagaacatttttatttctgccttcatttcgttatgtacccagtagtcattcaggagcaggttgttaagtttccatgtagttgtgtagttttgagtgagtttcttaatcctgagttctaatttgattgcactgtggtctgatagatagtttgttgtgatttctgttcttttacatttgctgaggagagctttacttccaactatgtggtcaattttggaataagtgtgatgtggtgctgagaagaatgtatattctgttgatttggggcggagagttctgtagatgtctattaggtcctcttggtgcagagctgagttcaagtcctggatatccttgttaaccttatgtcttgttgatctgtctaatgttgacagtggggtgttaaagtctcccattattattgtgtgggagtctaagtctctttttaggtctcttggggcttgctttatgaatctgggtgctcctgtattgggtgcatatatatttagaataggtagctcttcttgttgaattgttccctttaccattatgtaatggccgtctttgtttctttttatctttgttggtttaaagtctgttttatcagagtctaggattgcaacccctgttgttttttgttttccatttgcttggtagatcttcctccatccctttattttgagcctatgtatgtctctgcatgtgagatgggtctcctgaatacagcacactgatgggtcttgactctttgtccagtttgccagtctgtgtcttttaaatggggcatttagcccatttacatttaaggttaacattgtgatgtgtgaatttgatcctgtcattatgatgttagctgattattttgtccattagttgatgcagtttcttcctagcatcaatggtctttacactttggcatgtttttgcagtggctggtacttattgttcctttccatgtttagtgcttccttcaggagcttttgtaaggcaggcctgttggtgacaaaatctctcagcatttgctagtctgtaaaggattttatttctccttcccttatgaagcttagtttggctggatatgaaattctgggttgaaaattcttttcttaaagaatgttgaatattggcccccactctcttctggcttgtagggtttctggcgagagatccactgttagtctgatgggcttccctttgtggttaacccgccctttctctctggctgcccttagcattttttccttcatttcaaccttggtgaatctgataattatatgtcttggggttgctcttttcaaggagtatatttgtggtgttctctgtacttcctgaatttgaatgttggcctgccttgctgggctggggaagttctcctggataatatcctgaagagtgttttccagcttggttccattctccccatcactttctagtacaccaattacatgtagacttggtctgttcacatagtctcatatttcttggaagatttgtttgtttctttttactcttttttctctaaacttctcttctggcttcatttcttcaatttgatcttcaatcactgataccctttcttccacttgatcgaatcggctactgaagcttgtgcatgcatcacatagttcttgtgccatggttttcagctccttcaggtcacttaaggtcttctctgcactgtttattcagttagccattcgtctaatctttttcaaggtttttagcttccttacgatgggttcaaacctcctcctgtagctcagagaagtttgttattactgactttctgaagcctacttctgtcagcttgtcaaagtcattctttgtcctgctttgttccgttgctggtgaggagttgtgatcctttggaggagaaggagtgctctggtttttagaatttttaccttttctgctctggtttctctccatctttgtggttttatctacctttggtctttgatgatgttgacctacagatggggtttttttgtggatgtcctttttgttgatgctgatgctattcctttctgtttgttagtttttcttctaccagtcaggtccctcagctgcaggtctgtttgattttgctagaagtccacttcagaccctgttttcctgggtttcaccagcagaggctgcagaacagcaaatattgcagaacagcaaatattgctccctgattcttcctctggaagcttcgtctcagaggggcacctggctgtatgaggtgtcagtcggcccctactgggaggtgtctccaaattaggctacatgggggtcatggacccacttgaggaggtggtctgtctgttctcagagttcaaacaccatgctgggagaaccactgctcttttcagagctgtcagacagggacgtttaagtctgcagaagtttctgctgcgttttgttcagctatgccctgcctctagaggtggagcctacagagacatttgggcctcgttgagctgtggtgggctccacctagttccagcttctggccgctttgtttacctactcaatcctcagcaatggcagacgcccctcccccagccaggcttgcctccttgcagttggatctgggactagcagtgaacaagactccgtgggcaagagatccgcttagccaggcgcgggatgtaatctcctggtgtgtagtttgctgagtccattggaaaagcacagtgtttaggtggcagtgtcctgattttcccggtacagtctgtcagggcttcccttggctaggaaagggaaatcccccgaccccttgcacttccctggtgaggcgatgccccgccctgcttccacttgccctccttggcctgcacccactttcacaccagtcccagtgagatgaaccaggtacctcagttggaaatgcagaaatcacccatctcctgtgtggatcacactgggagctgcagaccggagctgttcctattcggccatcttgcaagggttttatcttaactttactggagacatcagaaggaggaagcagggaggagagagaaggagaatgaagacagacagacagacagacagagacagatatgcacgacagagctgtctgattctgattccatcctaagcgctttaaaatccatgaaggcctcttttgtccccagtggttcctaagtgaactcattctggatagctcttgttagttctttttttttttttttttttgaggtggagtcttgctctgtcgcctaggctggagtgcagtgtagtggtgtatctcggctcactgcaagccctgcctcctgggttcacgccattctcgtttcagcctcccaagtagctgggactacaggcacttgccaccacgcctggctaatttttttgtatttttagcagagacggggtttcaccatgttagccaggatggtctcaatctcctgacctcatgatctgccttcctcggcctcccgaagtgctgggattacaagcgtgagccaccgtgcccagccagctctggttaattctttatagcgtcattaagatgaagtgacttgaagcccatttaactgttcactccattatactgaagagccagtatttgtcactaaacagcagatatgtatccagatttctttggcgaacttgtattcttttttgctatacacacacacacacacacacacacacacatacatacatatatatatatacacacatacatatatacagatatatatatatacacacacatacatccatacacacacacacacacatactttaagtcctgggatacatgtgcagaacatgcaggtttgttacatagatatacatgtaccatggtggtttcctgcacccatcaacctgtcatctacattaggtatttctcctaatgctatctctcccctggcccccaacctctgacagaccctggtgtgtgatattccattccctatgtccatgttttctctttgttcaactcccacttataagtgagaacatgtggtgtttggttatctgttcctgtgttagtttgctgaaaatgatgatttccagcttcatccatgtccctacaaagaacatgaactcatccttttttatggctgcatagtattccatggtgtatatgtgccactttttcttatccagtccatcattgatgggcatttcggttggttccaagcctttgctattgtgaacagtgctgcaataagcatacgtgtgcatgtgtctttatagtagaatgatttataatcctttgggtatatacccagcaatgggattgctgggtcaatggtatttctggttctagatccttgaggaatccccacactgtcttccacaatggttgaactaatttacactcccaccaacagtgtaaaagcattcctatttctccacaacctctccagcatctgttgtttcctgactctttaatgattgccattctaactggcataagatggtatctcattgtggttttgatttgcatttctctaatgaccagtgatgttgagctttttttcatatgtttgttggctgtataaatgtcttcttttgagaagtgtctgttcatatcttttgcccactttttgatgcagttgtttgtttttttcttgtaaatttgtttaagttccttgtacattctggatattaacccatgtcagatggatagattgcaaaaattttctcccattctataggttggctgtttactatgatgataatttcttttgctgtgcagaatctctttagtttaactccatcccatttgtcaatattggcttttttttttgccattgcttttggtgttttaatcatgaagtctttgcccatgcctatatcctgaatggtattccctaggttttcttctagggttttcatggttttaggtcttacacttaaacctttaatccatcttgaattaatttttgaataaggtgtaaggtaggggtccagtttcagttttctgcatatggctagccagttttcccaacatcacttattaaatagggaatcctttccccattgctggtttttggcaggtttgttaaagatcagatggttgtagatgtatggtgttatttctgaggcctctgttctgtttcattggtctgtatctctgttttggtaccagtatcatgctgttttgattgctgtagacttgtagtatagtttgaagtcaggtagcgtgatgcctccagctttgttcttttcgcttaggattgtcttggctatatgggctcttttttgattccgtatgaaacttaaagtacctttttctaattctgtgaagaaagtcagtggtagcttgatggggatagcattgaatatataaattactttgggcagtatcgccattttcacaacattgattcttcctattcatgaacatggaatttttttttccatttttttgtgtcctctcttattttcttgagcagcggtttgtagttctccttgaagaggtccttcacatcccttgtaaattggattcctaggtattttattctctttgtagcaattgtgaatgggagttcactcatggtttggctttttgtctgttattggtatataggcatgcttgtgatttttgcacattgattttgtatcctgagactttgctgaagttgctgatcagcttaaggagattttgggctgagacgatggggttttctaaatatataatcatgtcatctgcaaacaaagacaatttgaattcctgtcttcctatttgaataccctttctttctttctcttgcctgattgccttggccagaacttccaatactattttgaataggagtggtaagagaggtcatccttgtcttgtgtcatttttcgaagggaatgcttccagcttttgcccattcagtatgatactggctgtcggtttgtgataaatagctcttattattttgagatacattccatcaatacttagtttattgagcgtttttagcatgaagtggtgttgaattttatcgaaggcctttttgcatctattgagataatcatgtggtttttgtcattcgttctgtttatgtgatggattatttttattgatttgcatatatttaaccagccttgcatgccagggatgaagccgacttgataatggtggataagcttttttatgtgctgctggattcggtttgccagtattttattgaggatttttgcattgatgttcatcagtgatatgggcctgaaattttctttttttgttttgtctctgccaggttttggtatcaggatgatgctggcctcataaaatgagttagggaggactccctctttttcaattgtttggaataatttcagaaggaatggtacagttcctctttgtacctctggtagaattcagctgtgaatccatctgatcctcgcttttattggttggtgggctattaactactgcctcagtttcagaacttactggtctattcagggattcaactttttcctgatttagtgtttggagggtggatgtgtcctgaaatttatccatttctcctagatgttctagtttatttgcatagaggtgtttatagtattctctgatggtagtttgtatttctgtgggatcagtggtgatatcccctttatcattttttattgtgtctatttgactcttctctcttttcttctttattagtctggttagagtctatctattttgttaatcctttgaaaaaatcagctcctagattcatggattttttgaggagtttttcttgtctctatctccttcagttctgctctgatcttagttatttcttgtcttctgctagcttttgaatttgtttcctcttgcttctctaattcttttaattgtgatgttagggtgtcgattttagatctttcctgctttctcctgtgggcatttagtgctataaatttccctctaaacaccactttagctgtgtcccagagattctggtttgtcgtctctttgttctcattggttttaaagaacttctttatttctgccttaatttcattacttacccagtaatcattcaggagcatgttgttcagtttccatgtagttgtgtggttttgagtgaatttcttaatcctgagttctaatttgattgcactgtggtctgagagacagtttgttatgatttccattcttttgcatttgctcaggagtgttttacttccaactgctaactagaataaccagtttagagaagaacataaatgacctgatggagctgaaaagcagcacgagaacttcgtgaagcattcacaggttatcagtatcctaattgatcaagcagaagaaagaatatcagagattgaagatcaacttaatgaaataaagcatgaagacaaaattagagaaaaaagaatgaaaaggaatgaacaaagccttccagaaacatgtgaaaagaccaaacctacgtttcattggtgtacctgaaagtgacggtgagaatgaaaccaagttgaaaaacactcttcaggttattatccaggagaattttccttccccaacctaacaagacaggccaacattcaaattcaagaaacacagagaacactgcaaagataccccttgagaagagcaaccccaagacatataattatcagattcaccaaggttgaaatgaaggaaaaaatgttaagggcagccagagagaaaggtcgggttacccacaaagggaagcccatcagactaacagaaaatctctctgcagaaaccctataagccagaagagagtagtagccaatactcaacattcttaaagaaaggaattttcaacccagaatttcatatcgagccaaactaagcttcataagcaaagcaaaagagaaataaaatcctttatagacaagcatccaggcctgccttacaagagctcctgaaggatgcagtaaatatggaaaggaaaactggtaccagccactgcaaaaacataccaagttgaaaagaccattgacactatgaagaaactgcatcaactaatgggtaaaataaccagctagcatcataatgacagcatcaaattcacaaataactgtattaaccttaaatgtaagtggggtaaatgccccaattaaaagatgcagactgtcaaattggataaagagtcaagacccatcagtatgctgtattcaggagacccatttcatgtgcaaagacacacataggctcaaaataaagggatggaggaatacttaccaagcaaataaaaagaaaaaaaaggaaaaaaagcatgggttgcaatcctagtctctgataaagcagactttaagccagcaaagatttaaaaagacaaagaagggcattacatagtggtaaagggatcaatgcaacaagaagagctaactatcctaaatatatatgcacccaataaaggagcacccagattcatgtagagacctacaaagagacttagactcccacacaataatagtgggagactttagcaccccactgtcaatattagacagaacaacgtgacagaaaattaacaagggtattcaggacttgaactcagcctggaccaagcggatataatagacatctacagaactctccaccccaaatcaacagaatatacgttcttcttagcaccacatcgcacttactcaaagttggattcttagccttccaaagttcacatgctatctctcaccagtatctttgtttttttcttcttcatcaattaggatgatttagaacaccagtaatgttgatatagcattgtttccacttattattgtgtttaattcttttttccacagttgatatagttttctttttttctttttgagttggagtctcgcactgtcacccaggctggactgcagttcactgcgatctcggcttactgcaagctccgcctgctgggttcacgccattctcctgcctcagcctcccatgtagctgggactacaggcgccggccaccacgcccggctaatgttttgtatttttagtagaaatggggtttcaccgtgttagccaggatggtctcgatctcctgaccttgtgatctgcctgcctcggcctcccaaagtgctgggattacaggcgtgagctgccgtgcccagccaattgatataattttctgtaggaagatttgtttctgaagtgagcaaaataatgattcatttctaaattaataaaacattctctttgtgactgtaatcacttgtatagtctgttggaaaggagcaagagatcaaaatagtgactcatccaagaattatttatatttcctgttggtctgtgagtacatttgaggtgaatttaccttttaaattatgtttctttctgctgatactaatattggtaggtaatccttgatcttacagcaaataatatttaaaactcaggaattttgggggtgacaggagaaagacagaggagagctaaaaaataccaatgccaatctactttatagttaatagaaaattatatttggtattgtttttgttaaacatcagatgttgaatgattattttcttttgatgcaagtatatttctaaataaaggagaatcagtagcactaaatattaagagcagtgtgaacattaaaaacagttaattttttaagtcttatttgactttatattggtgtgctcataattgtaaggtatggaattatttctccagctataaccctgagcaggttttgttgcacatgtctagtaggctccagcactgaagttctcaatcaagcaagagaattagatacaatctatgccctggggactagaatgcatagttgagttgttccacactggtataattatgatcagtctaacatctggaatcatcagttttaaatgtttaactactctgaactctgacccaaatccacatatgcagtcataaatagattttcctcttaataggaggattgacaattaatattctaaataattattttgtaaaatgtttatgtatttgccagaatctgccagacaatcaaccttttatagtaaatctcagctgataggaagccttttaaaaggattataagttgtgaattagcatttaaacaatatttttaatcgtttagacttagacatttactttagaaaatggacagagaattcttggccaggcgtggtggctcacacctgttatcccagcactttaggaggctgaggtgggcggatcacgaggtcaggagatcgagaccatcctggctaacacggtgaaaccccatctctactaaaaatacaaaaaattacctgggcatggtggcgggtgcctgtagtcccagctactcaggaggctgaggcaggagaatggcatgaacccaggaggcggagcttgcagtgatccgagatcatgccactgcactccagcctgggcaacagagcgagactccatctcaaaaaaaaaaaaaagaaaaagaaaaaaatattgatagagaattcttgatgggcttcttgagataggcatttttccctcagaaaataattcaatttattgcaaactaaacttcattttttgctgctgttgacacttccttacagtcagtagagagagcacaagttttctatcagtcccttcatcacaaactgaagtgacatcattaatgatggtataaagggtgaaaactctagactaattcatattggctcatgtttctgggaaaaatttaaatttaacaggtagaaagccaagaattataaagatgaaatgtaatatcaggtttcagagaccatctgttaagtcgaatgatacagtaacaagaataaattgacataattcctttaaaatttaaaaatctggggccgtgtgcggtggtgcacgcctgtaatcccagcacattgggaggcagagacaggtggatcacctgaggtcaggagttagaggccagcccgacaaataaggtgaaaccccatctctgccaaaaatacaaaaattagctgggcatggtggtgggcgcctgtaatcccagctactcaggaggctgaggcaagagaattgcttgaatccgggaggtggaggttgcagtgagacgagatcgtgccattggcactccagcctgggcaacagagcaagactccgtctcaaaaaaaaaaaaaaggcccagcgcattgtctggcacctgtaatcccagcactttgggaagctgaggtgggtggatcacctgaggtcaggggttcgagaccagcctgaccaacatggagaaaccccatctctactaaataaatacaaaaattagctgggcatggtggcgcatgcctgtaatcccagctactctggaggctgagacagaagaattgcttgaaccctggaggcggaggttgcggtgagctgagattatgccattgcactccagcctgggcaacaagagcgaaactccatctcaaaaataaataaataaataaataaatgaaatttaaaaatctgggctatcaaagcaaaaatggacaaatgggatcacatcacgttaaaaagcttctgcacattaaaggaaccatcaaagtgaagaaacgacccggaaatgggagaaaatatttgcaaactactcaactgacaaaggatttataaccagaatatataaggagctgcaacaactctataggaaaaaatctaacaatcctgtttaaaaattggcaaaagatctgaatagacatttgtgaaaagaagtcatacagtggcaaacagacatatgaaaaggtgctcagaatcattgataatcagagaaattcaaatcaaaactacaaagagatatcatctcaccccagttaaaatggcttatgtccaaagtcaggcaataacaaagctgacaaggatgtgaggaaaaggggacccttgtcactgttggtaggaatgtaaattagtacaaccactatcgagaacagtttcgaggttcctcaaaaaactaaaaatagagctaccatatgattgagcagtcctattgctgggtatacacccaaaagaaaggaaatcagtatatcaaagaggtatctgtactcccatgtttattgcagcagtgttcacaatagccaagatttgaaagcaacctaagtgtccatcaacagatgaatggttaaagaaaatgtgttatttatacacaatggagtaccatttagctttgaaaagaatgagatcctgtcatttgcaacaacgtggatggaactggatgccattatgttaagtgaaataagcctggccagaaagacaaacattgcatgttctcacttatttgtgggatctgaaattaaaacaattgaacttttggacagagagagtagaggatagttattcgaggtagggaagggtagtggggtcgggaggagatggcagtggctaatgggtacaaaaaaaaatatttagaaagaatgaataagacctagtatttgacagcacaacagggtgactatagtcaatagtaacttaattgtacattttaaaatatcgaaaagtttaattgtattggttataacacaaaagatgaatgcctgagggaatggataccccattttacatgatgtggttattacacattgcatgcctgtatcaaaacatctcatggaccccttaaatatatataactactatgtactcacaaaaattaaaataaaatttaaaataaaaatctaggttatgctagattaaggactaaatttagttttactggagattatgttgtttatgcattattttcttataaaatttgaagttcactttagggctatctgaaataattacttatatgatatacgaaacttatatactatactaaactttgatgtactatacagcaaaagaggtagtgatttatgtgtgagccagttatgtttctgtcttcttcaacaaggattagaattttattttcagggcaaaacccagaggctgattgtattgtgattaaggacttaatcattaattaagaacatatatttcagcaaaataccccatatatttctacaaatagtagacaaaaaaaattttacaccaaaaaaaacttctataaatatagttccatgaaatgtttacatgcttcgtgagcatttgacaggacatggaagatgatcattgtccttgtcaaatgttgttattaatttgttcgaatggtgctattcagactattctgcaaagaaacccaaatggcatagatgcttatttgtgctactgtgttagggttaattaagcacagagaaaaccaagccagtttaatatccctctctagtatcttatagctattaaaataatgtccctgaacattttaataaaacttttatttttttaatgtaacagctgtttaagttaaatagggcctatggaaatagattcattttataaaggagttaattgagatatatcgagacttagttattcaaggttatatattatattaagactgtcatcaaaaccagaatctggagctcttgactcctagttcaaggagttgccaacttaaagtttatgctgaagtaatctaggggagatgattctgaaaatataagaacattgtttaaattgctgatcttttgctaagtgcctgttttgtgcaaaatattatgtcattacttttgtttgataaaaagatgaaaaaaatcataatgtccttgaagctatattgtgtaatggtgatacaaatagtagacaaaaagtgtttaaaacagtaacatgtttatatcatatgaaagctaagaatactttttagagccaatgcagtagagaacaccctacatactaatatatagtgaaggagaagatttggaggaaatagccaaggagattcctctgcttatgtaggaagagaatagctctgagattgagggctaataccccttaaataagattactagggcagtcaagttgagcagaggtcgttctaaaagctatttatagttaagatgtaatgctaaatagtgtaatcatagagatagctgagtccttggaaactatctagtgcaggcattagttttacagttaaagaaactgagactcagagtgattcttagttatttgtttgaagttagttatacagctggatacagccagagctagaatttgatcctttccaaatgactggatatgaaaaaaactaggaaacagattaataagagaatctggaaggtggcaaattctggaaatgtattggaggtgtagagtgtaatttttgccgagatatgatttccatcagtctttgcaagaggggaagagagtgttaatttttggtttcttgggcaaagtaaatcaaaatagaaggctgtagggatccatggaacaatttgaaaagtaggatgagctgcctgatagcctttaggaaaatgaccttcccagcaacgtctaaggcattttattaataacaataatatatgtaataatgatattaacagtgacagctatcatttattgaatgttaggcatcatgtcaagtgtctgtgtgtagtagtttatttaattattttaatcctgtgacctaagtattttcatgctatttgtagatgaagaaacaaaaactctgataggttaagtcattatctagtcatacaggtagtcagctatagaatcaaattttgaatcctgatctctttgaattctaaaaatagtgtatctcaaacttgagtaatgaataggccctccttctaaaggaaagataatcttcccgcaccccatactgacttatttttattataagattacttaactaggtgtaaacacaaatttcttaagtttatagctcatattgtatagtttaaaaattaaattaaatacaagcaaaacttacaaaatcagtaaaattcaaatttatgacgttaatttaatgtaaaagatttttttcctgaaatgaagatgctgattgcaagatgaatttacagctaactactactgtataggttcttttgagtttggcatgcccatactgccatgtgctttgtgataacttagttctcctaccacttttctctatttgaacttcttcaaaatatcccttcaggcaatactgtctagtatcatttgaccttcacttggtgtaatcagttatttattgttaatcttgcctctgttttcattagttgtgtctgccacttgataccaatttaacagtttggggctctgaattgtcacagcattctgtatttaattataaggtgatggtcagccatgtgatctatattatgtttatgttaattattttttaggttatcatctagagggaaccacaaaattaaaaaaaaattcacggattcagccaatcttaaccaggcctttgttgttttgacctaaagaaaaattgtgctgcactttctctcaaaactctgtacagtagtactacctggtttctgtagggtagtagtggagatccagaaaatttgccatctccatccacttcagttcaggcctctaccattttgcatctgaatttctaccacagccctcagttttattcccaccaaactgctttccacagtgtgagtttttaagaatataaacttctaggactcagcctaagaatcacctctttctggacacttttctccattgtttctcctatgtctagcttccccttccatctgtcatacttcaccattttctctcctagattgaattagttagcttttcttcctatttcttctttataactccataacaccctgtgcacacctctgttataatgcttagcatattgtattgtaatccttattttttcagtcttccaagtagaatattaacagcttcttcttcctcctcctcctcttcttttcttcttgttctttcttctcctcccccttgttctccttctcctcctccttagcatatggtattgtaatgcttaatttttcagtctcccaagtagactattaataacctcctccttctcctcctcctcatcttcctcttcttctcctcctcctcctcctcccctctttctcctttcctttttccttttccttttctttttttctctttcttttgttctttcttcttcatcttcctctttttcctctccttcatcatcttcttcattgtcatcttcttttttcttctttcttcttcctcctcctttttcttctttcttcatttcttcttctcctcctcctcctccttcttcttcttcttgtttcttctttcttcttttttcttccatttttttttttgagatggggtctcactgtattgcccaggctggtcttggactcctgggcttaagtgatccctccgcctcagcctcccaagtagtttggattacaggcacatgtcaccatgcctggctattggactattaatttgaaagtaaagcctagcttgtgcatctgtataactagcacattatctgaatgagaagaaagttccactgatagagttatgatcctgaatcactgattagtcagttgcgatttttattttattttattttttgttttgagatgaagtcttgctctgtcacccaggctggaaggcagtggtgtgatctccgctcaccgcaacctctgtctcccaggttcaagtgattctcctgccgcagcctcccaagtagctgggattacaggcacgagccaccatgcccggctaatttttgtatttttagtagttacagggtttcaccatgttagccaggctggtcttgaactcctgaccccaaacgatctgcccacctcggcctcccaaaatgctgggattataggtgtgagccaccgtgcccggcccagttgtgattttagaagtgaggattcaaaggtaggccaaaacaaagtcgacattttcttgtctttctcattcatgtgtgtaaaatgtatatgaatgacctaaatagttaacgtaatagactatttgcgtatgtaagcaacataatgctggaagtaatttctccatagagaattaaaagataatagtattttgtttatctttggctaggtgctgtgattgtctccacgccccaggacatcgcattgatggatgcacacaagggtgctgagatgtttcgcagagtccacgtgcccgtaagcgtttacagcttcactgtgaaaaatataaaactcttctaactgaagaagcaagtcattgaaaaatacagttgaagttttaatttagtcctgtacagaagtctttatgaaagtcctagtttatcattttggtgactttaaaaacacacttataggtacaaacatgtctatacatgatattaatccataagaattgtaaaacaccctttaggtaagagttttctatagaagtgctacttctctcatacttgcagctatcactgacaaaaaaaattacaagagtgttttaggaaattatttagatagataggcttgaatagatcacttatggggaagcggatgaaaaaaagattacttttttccttctgcctcctacagttcaactcatttatagctcaccttcttctaggagacacttcaggattttctccctaatttggtggaatgaaagttaaaaataagataaaaatagacaaaataattaaaattagatggggttagaagtgaagtcagtaaacaaattgcctgctattaagaaacttaaatacatgctaggggtgtaccgtgacttttctagcagccaaaggaaaagaaaaatagtaccattataaaactgtgcatttctacaaagttaaaaaaaaaaaaaaactggatgctcaaaagagacagagctgagaccagagagaaatatcttccctaggttcttagaaagaagaacctgtgtatgtaatgaacacactctcatcaccttctttatagtaaatacagggttcttccttctagtgtgcctcaatgaaagcaggtggaattgtgctggagtacaatttaaagcaaacatttcagtacagtgtcaacatgatgcttctctgtggctggctagctagtggccttgcttaattcaaagacagattttagagcatatatatcagagctttttaaactttagtctgtagattagcttcaggagtctcatgttttttctctccctcacctcccccagccctaaattgtatgcctacaagtatttgttttggtatggaatgaattataacttttatcagattcttcagtgagaccatgacacaggataagatccagtaatgtatttgaatgaatggacttgaagggaagctttcataaatgtttatctctcagagggcttctgaaaagtgtaaaatagtgtagtagaatggttgaggtgaatttcctcaagtacctcttctcccttgccagttagcacagtgctgtgggtattggcaagctgaggaactctgggttggattgacatgttctcgtgaaaatcgaggaggcttataaggaaggtgcctgtatgcttaccttccaggtggtccaagggtttttcactagcaggtttataattgtaatcagcaagtagtttagggccagtgttctatgtcgtgaactttaggttggaaaatttttaaaacagtgataaccaaatgcctgcctcacaccgaaaactctctctaaagcacctaatttgagcagtgttactttgtattatgccctctaagacaaactagacacaagtaatgcctacccagataactaaataaggttacttgttataggggattttaaaatataaatcagcaaaaagttaggaggttatctaccaaaaattatgacattgacttaagtaatctataatccttctttctggcagaaattagataacagtgccaattgtctattaagatcactccaaagtcaggataatagccattctatttgcacataagtgaatgcttaacttctcattctgtaagatgagagttgagggtgttcagctcacccaaaaacatgaattccttgaggaaaaagttttaaacagagcaggagtaagacctttttaaaattttaccccctataaattatcattttatatatcaaaataccatttcaactgacactgtcatttgaggtgactggctgtggagaaagtcctacatggactttgctagttaggagtctaatgaccgtagttgccaaattcagcatatattatttttcagtccctatgtaaacctgtatacctgtgaacgtggatacttaatctcatactgttctgacagattttttcctaaattctaagacagagggttggacagataatccttatggaacataacagagaggaaaagggatggtcactaagtccaggttaggctattgttaggtgaatgccactgaaggatagacgttaaggatattagcaaggaagtattgtgaggaagtattccaaatgaaggctgatggactgcataaggctcataggactacttcagggatcagttagaaggtgaaagagctgtttgggatcagaaagttgatattagagtataagtttgccaagttagagcagttctgggtcatgacaaggtccaggatgctgtcatgggtttgtgggacttagtgggagtagaaatgaaagtcattggaactgtgtaattcttccaagttgaaatttatagttctttcctctggccttttggacatcttcctgtatctttattacagctctctttttttttttccaccctacatttaaattatttgccttctaaactacaaacattttttaaaagagatagaaggtcttaatcatttcttaaacctgcagaacaagataggtattcagtaatgtttgcaagtgaatgagtgagaactttccagcaataagctctgtgaacagttgggcaatcatgattagctacattgtaaagaaggtctgggctatgagtgggaagtggatttgttgacctctgagatccctctgggccttaagagccagccccacagccaaagtaatagtaaaggatttgaaattattaagtgttttataaatacaaaaaaagatgttatgctttgtttataccactttattccatttcttccccttggtttttagtccagctctctgtttttcccccatttgacgtgcattagttaccatggaaacgatgatgtcattggaattcatcggtatggacagagtttagtaatgtctgcaagaacatattgaagttaatttaaatgatttcttaaaactcaaggcttagataggggaagtaggagaagagatgagctattaaattctctgttctctgcctgaaatgatagcaactatgccaaatcctcaattatctcaatatttgtaggtagactatttttttaaacaaaataaaaattttcagtcttatacatttttaataatgagtaatttatgtgttgtgtcattctcactcatttttcttgccttcttatatgtgggagtcccaggcaccccgatctggagcccttctcctaccatttgaacttctgatgtcaaagggatttcactatataccccttccttctttgataatctcattccctgctactgaaaagtaaattaaagtatatttattctcttactccttcggcacataagggatcacttagttacttttaattcaacaaatgtgattaatttatttttccacaaatctatatttactgatatttagtgtcttctataagcaaagtgctataataaacttccattagtggtttagaaaaaaataaagaggatgaagcctctttcttcaagtactttatatcatcctgtagactaactctattttgatgcaaaggccttaaattctgagatgcatgaaaacactttttcttccaggctatcagggatgactttatggaaaagccatgattatttttttcatgccactgtaattttacacatcctggtcctttgcctgataagccatggccaatttagggaactcatgtattcatttttaacatctctgctcagacattatttcttctagaaagcttttcccagtatgccaggaaaagttaatactcctgtctcagatctacttacacatatatttagtttggttcttattccactgcaggtttacctgtcagtcttcacagaagaatgcaggttttggatagcaagaaaacatgctttaaacattcttaaatgcatagttacctggcatatagcaggcaggatactttgatctgggatgtaatgccatccacatctgctgttccctttaccccaactcatgggctactctgccttgctttctctgtgccacagccaaactggtcttcttccacttctttgaagtttccacacaccatttttctcctcaggacccttaccatgcttttttcctactggagaacattttaacctcacttttcacctgttaactcctttttatactttggtacttagattaaacaaaaagcttttctcagggagaggtgccctaatcctttttatttatttatttatttatttttttgagacagtctcgctctgtcacccaggttggagtgcagtggtgtgatctcggctcactgcaacccctgcctcctgggttcaagcaattctcctgcctcagcctccctagtagctgggattgcagtcacccaccaccacgcccagcttatttttgtattttagtagaggcggggtttcaccatgttggccaggctggtctcaaactcctgacctcaagcaatccacccgcctcagtctcccaaagtgctgggattacagatgtgagccacggtgcccagcctgccctaacccttttatgagcttttttaattttatgatccaattacactctattactccttttctaactgttttcacatttgtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttcttcttaagattataagaggagttcataaagaatgctggatgggaagtaaacatcattaggatagagctttacaaagttttaatctgatagagatgaataaaaagaataggagccaggaaacatagaggaagtaagggaacatttgcaatgatcaaagttattcatgctgcagattgtgacccaccaacagatcgtgaaattgatacagtaagagatgtaaccaaaaatgcttaaaccatgtcagagtaaattgctcttaggaagacagtcttatttcataaagatttggtctcaagtataaatacacatatgtgtgtattgtgtttcttcctgatgtaacagtactattacagtagatgaacagataagcagagtggccttcttccatgtagtcaagatgtgaaatatttcttttatcagtaagacagtttaaaaagttggaaaaacatggtgtaggtgataggcagtaaggggcttaattagaataatgccagtgaaagtggaaggggaaatgaatgtaattgacattttgaaggaagagttgaaaatcttgggaatcgattgtatagggtaggagagttagaacaaaaaaggcagaaatcaaaagaattttgagagttatgatgccattaataaatctaccaggagctgctttgtagctcaggtagacaacaaactagaaataagaggttaggttctcagtcacaaatctctgcccttcttctctttgagagttgtgatttaatagtgtttgtcaaggaagaaactggtaaagatactgacaaaagaaatactctttaaaaaatttcttatatacagatttttattaccacttagagaactatatttttgatattcttttgtggtttcaaattaaattgctttccaaattttcttataattttttagatgataggaaactacttgcagaggcatttttgcatagtagtgaagagcatgagctgaggagtttgaattgtagatcccagctctgccactttgtaactgtatgacctgagttatctattctatgccttagttttctcaatcatcatatgggaatcatagtaatattttcctcaggaggttaagatgagaaataagataatgcatataaatggcttaagtacagttcctggcagtctaagcactcaatgtttacataatgttatataattaattttttcttgtaattactttttagaatgttatgaaacagataaatttacagatttttatgtattttacctgggtattttaactaatccctttagttggtaataagaatttggggctgggcgtggtggctcatgcctgtaatcccagcactttgtgaggccgaggcaggagtactgcttgaggctaggagttgaagaccagcttaggcaacatattgagacccctgtctctttaaaagaataaaaaattagccaagtatggtggcatgcaactgtagtccaagctactcaggaggctgaggtgggaggatcgcttgagcctggaaggtttaggctgcagtgaactgtgatcatgtcagtacactccagcctgagtgttatagagtgagaccttgtctcaaaaaaaaaaaattaattagaattttaaacactactgttttttgagatttctttattccttgagtatattcattgagccatctatattatcttcatatagatttattaagttgctatattattttgagtctaaaattctgcattatttgaaatttacatcatttaaggaaggctaattgctgttacaagtagaccccaaaatatataatgatacaaatacaatggcagtttctttcttgctcatgtaacagtaccattacagtagatgaacaggtgagcagagtagccttcttccatgcagtctttcagactgttggagcctctgtcatcttcaattgtgacttctaaaattacattaggagccatcttcattctagctagccacaaggaaagagaatacagagggatgtacctacattggagatttttatgggccagacctagatgtgatacacatacttctgcgcacattctattagctaaaatcagtcacatggccacatgtcatatctctcaagaagcctaagaaatatcaattagttgtgtgccaaggaagatgagatcatgaattttggtgagcagctagcagtctataccacatttgacctggaaacaaatatatagattaaatcctaatgtagatcactgaactgatttatttcctaataaataattctgaaaattgtataactattttactcttacaaatatttattttataaaggagagatagaaattctacctttcctgtggtttaatttttctgctaaaaacaaaaaacagagacaagcctactgtggcctggaactttttttttttttttttttttgagacagagtcttgctctgtcgccaggctggagtgcagtggtgtaatcttggctcactgcaacctccgcctcctgggttcaagcaattctcctgcctcagcctcctgagtagctgggactacaggctcctgccaccatgcctggctaatttttgtacttttagtagagacggggtttcaccgtgttagccaggatggtctcgatctcctgacttcatgatctgcccaccttggcctcccaaagtgctgggattacaggcgtgagccactgcgcctggccggtctggaactttttagtatttatttgtaaaggttaaggattatattgtttacttagaaaaattagacgatctttattacctttatgagactggatagcattctgcatctcagccataattatttctcagagactggagatatatgcttatttgtgactttccccaggctctctcagaagtctatgtatgctttgaactagaatgctgttctatgtgagttacataaattaaactcatctctcacaacaaccctgtgaaatacagaacatcatttcccccattttgcacatgaggaaatgtggttgagagaggttaaataacttacataagaatatctatttgtttagtgggacatctgggctctgatccaagaagtcagctttccagagcccgtattcttaactgcagtttctgtggatactccagagttgagttttagtactgtggacatcatggactatcacagggtgacagaatctagggtataagagggttcttcatcaaatttgcttgttattggggttctgattattaaggtagacaagtgaagccagaggaaactggtggattgaaaatggggaggagttaaggagccataggttctgttgacagttaaggaggtatcatgtgggcgataaggggaaggggagttccacgtccaggatctaggagaaaggaatgaagcctaagacttgactgcagcactgggtggtaaggatggctcaaatcaggcctgccctgtaactgtgctcttaattactatgctatattgctcaactttattgactcattattattttaagccacctaattccatgcacaaaagtctctatctagttgtcatcttgtttggtgacttccttatacaaaccagtcactcagatagtttgaattttggctttgtcatttactaactgtgtgaccttgagcaaataatttagcttcagagtttccttccatcatatagggatgataatacccatctcattggtcactatggcagtgaagcatgattatatttacattacttagcatagccttagcacacggtatggtaaagggtagctctgaatgtttttgatatagtggtagacattagagatcattataaatctttgttttcaagattaagaatgcaggacatagagaaattgagttgcacctcatggacccacaactatttagttggtccctgaaaggagcatggacacaggcccccccattcattgttctttccatgtcaaatgactatttctgaaagagaaaacaagaacacctgtctcatttttaaaacttataacatccatgcacatgcttcaaggagtataccaaaaactggtttgagtctaacaaagaactgaaaagcagttatgaatctaatctatttcagttattatcattcattatttaacaatgaatttttcctcctcactttttcttaaatcatggcttttaatgcttgtaacaggttccaaccagcaagcatttaacctgattgtaacctggataaattggattatatagtagcttaaaaatcttgcttgttacttacctgtatctgggtttaaaatgtgaaaaataaattaaaattggagccttttgggcctccttaattcaatagatttagacagaaaaatccaatattcagagcgatgttcatatttcaagagaatcaatttttaaaaagttaagaaaagaagtgcccttctgagccagtgatggattggaatactgcaaaaatcacacgcaaaaaggttgtggtggctgatggtagccaggcatgtagtatttgctttctttcagtaaaagtagctgaggtaaaaagaaaaaaggaccttatgctttgatgagacattaaaaaatgattgagcatgcttacagctgtatctcagtggtattatgtaaattaagctatagcaaagaatctgttttctaatgtttctgctattaaaggatatacacaatagctctacaataaatacaaacagcttaacagtatatgaagtattcacaagatgtaaggcttatttggcggggaagacatcataatggacttgaattctttcctatttaagagagaagaatttttaatgaacaaaactgtaatatggatattctaatgttcttactgcattagttgcccccattcaaaacctccttgattatggaggattgctgttaagtgaacttgagcagtggtttctaagctttttaatacccaaggctttcttttaaattgtcccccagctaaccccatgttttgaaagaattgtttgccactgtttgcatatgttaattaatgactgatgtcttctcttttttaataaatcaaagatagaatatataaataatatgtatgtacatctatatatagatataactgtatctctgtgcatacagagagagacatacacagagttatgtatataactgttgtatgagctctgcacagaatgagataaccataaaagaagattatcacatttggctgatgtaatttcaattaaaagcacagaaacttggtagtttatctgtcttgtatatttttaaagtgttttatttatgttcagtttttaaaaatattcgtaataggccaggtgcagaggctgaggtgggaggattgcttgaagccgggagttaaagaccagccttggcaatacactaagaccttgtttctacaaaaaataaaaaattagctgagtgtgctggcatgcatctgtagtctcagctacttaggaggctgaggcaagaagatcgcctgagtccgggagttgcagtttgtttgaggcttcagtgagccgtgatcacactactgcattccagcctgagcagcagagtgagaccctgtttcaaaaaaaacaaaaattcattataaatcacagaacctgacaaaatatttttgtgcatctttagacccttaaaagattaggtaggagaactaccaaaatagcttctacagtcaggctttaattttctagagcagcactgtccagtggaaatataaaccatggaaatacgaaccacaaacgtagttttgaagtttttagtagccatattttaaatagaaagaaaagaagaagttaattttaataatatatgtaccacagtatattcaaaatattatcatttcaacatgaaaaccacataaaaattattgaggatcaaccaaaaaggaattgtatttgaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagcaaaaaaaaaaaaaaaaaaaagagagagacatgtacaaaaacattcacagaagcattatttacagcagccaaaatctggaaacaacccaaatgacccaaaaggagaatggatatttgtggtatagtcattataaaatcttaggactcaatgaaaataaattacaggtacatagtttagctggatgaatcacttggacacaaaaatatatattgcatgattccattagtatcaaattcaaaacaacacaaaattaatttatggtgttagaaagcaggttagtgaatacctttgggaatgtgtttggaggatatatagggaaacttctggggtgttggcaacattttattaacagggtcttggtaacatgggcatacattttggtgactccattttgcctaaacttaagtacttttttgtgtgttcctgatatactttgatggaaaaggttaaaaataaataacttgtaaactttaaaaattattcagatattttacattttttttacttgtactaagtcttcagtacttagggtgtattttatccttataagacatgttaattcagactagccacatttcaagtatccagtagccagccacacgtgactaatggctaccctattgggcattgtgggtctatagccctaccattttagagcttctatggagttagactttatttcagggctttcgttgaagtattaattaggaagaataggagattattcctcccaaggaactcattttaattttactgcttttggttttatagaatattttctattgaaaaacagatggttgtttttatatacaagttcacaagacacctaatatgtcattgttttggttttttgttcttattgctttattaccattcttctcatgaccaccttttttaaaagcaaacttttcattgaagctgtgacatacatacataaaagggcacaaattatagctcaatgaatttttacaaagcaaacatacccactgtttgtatcccagaaatagaacaatagagagcctagacatcatatatttacagtcaattgatttttgacagaggtgccaagaacacacaatggagaaaggacagttgcttcaataaatggtgttaggacaactggatgtccacatgcagaagaatgaaattagacccttatttcacaccatatataaaaatcaacccaaaatgaagtaaagacttacatgtaagacctgaaactatgaaagtattagaagaaaacctagaagagaagctctatgacattggtctgggcaattatttttctggatagacaaaatagcaaaaatagacaaataggattacatcaaactaaaaagcttctgaacagccaagaaaacaatcaacagggtgaagagactacttacagaatgagagaaaatatttgcaaaacatgcataaggagttaatattcaaagtatatgaggaactcaacccaatagcaagaaaacaaacaacctgatttttttaaatgggtgaaggatctgagtagacatttctcaagagaagacatacaaatggccaacaggtatgtgaaaaaatgctagtatcactaatcatcagggaaatgcaaatcaaaaccacaatgagatatcccctcatacctgttagaatagctattatcccctcatacctgttagaatagcaaaagaaaagtgttggcgaggatgtgaagaaaagggaacccttgcaccctttgggtggaaatataaattaatatagccattaaggaaaatagtatggaggttccttaaaaaaattaactatacaactaccatatgatcctacagtcccactgctgggaatatatccaaaggaaccgaaatcagtttacgaaagagatacctgcactcacatgtttactgcagcactattcacaatagccaagatatggaatcaaccaacagatgaatggattttaaaaatgtgtacacacacacacatagacacagacaatggaatactatttggcctttaaaaagagagaaattggccaggcgcggtggctcacacctgtaatcccagcactttgggaggccaaggcagatggatcacgaggtcaggagatcgagaccatcctggctaacacggtgaaaccccatctctactagaaatacaaaaaaattagccagacgtggtggcgggcgcctgtagtcccacctactggggaggcggaggtaggagaatggtgtgaacccagaaggcggagcttgcagtgagccaagatcacgccactgcactccagcctgggcaacagagcaagactccacatctcaaaaaaaaaaaaaaagaaaaagaaagaaatcctgtaataacatggatgaacctggaggacattatatgaagtagaataagccaggtacagaaagactaatacttcataatctcacttatatgtggaatccaaaaaaagttgtattatagaggtagagagtagaatggtggttaccaggggctgggcagcagggattggggaaatgtcagtcaaacaatataaaatttcaaaataagaaatagaacattaccagcatcctaaaaactcctgcctgtgccaccttctagtcactaccccaaaatggaacccgaattataacactatagattagttttgcttgtttgtgaaatttttacaaacagaataatatagtgttatacgtttgtgtgtccggtttattttgtttaaaattatgtttgtgagattcacttatactgctgatagttgccatcgttcttttcttgtcattgctctgtagcattccattaaatatatcacagtttgtccattttattgttgatggacacgagtagttttccatttttgactattatgactagtgctgttatgaacattgttggacatgtcttttagtgaatgttttgttcatgtttctgttgatacataactggaagtggaattgctgggctgtagtataaacatgtatcagtttatgtagatactgccaaacagttgtttaaaatgattgtacccatttccactcaactgaaacaatgaatcttacttgtttcacattctcacaaacatttgatataattttgttttttgtttagtcatattgatatttcttttctaatacagtcttaagcataaatgtactttgagtatcttcttttgtggaatatctgttaaatctcttgcccatttctttattgtattatctggcttttccttattggtttgcaggagttctttatacattatgggtaaaagtcctttgtcatgtatgtgtattgtatataccatctcccactctatagcttgccctttcactcttgaatcatatcttttgattaatttcttaattttaatgtagtccaatttaatttaaataatttcatttgtgtctagtgtaactttgtgtcctgctagaaaaatctctgcctgcctgcagcattagtatattgcctatttttttctaaaagtgttattatttacctgtcatatttagctctaaaattcacctggaattaattgttgtgtatggaatgaggtaggaggttaagattcattattttatatatggatatccagttaacatgcagtactatgttgtctccattgtaacttagtgactttcatgtatgggtcgattctgggctttttttttttttttttttttttttttttttgagacggggtcttcctctgtcgcctgggctggagtacagtggcacaatctcagctcactgcaagctctgcctcccaggttcacgccattctcctgcctcagcctcctgagtagctgggactacaggcacccgccaccacgcccagctaatttttgtatttttagtagagatggggtttcaccgtgttagccaggatggtcttgatctgacctcatgatccgcccgtcttggcctcccaaagagctgggattacaagcataagccaccacgtctggcctgttctgggctctttattctattacaaccaagttttttggtaaaatcaagcaaagtggtatatgtgtgggacgttcttaagatgaggaaattctagagttaagtggaattaatttattcaagatgtctaggaagcaatattagaacatttatcctttaactaggagaagttacatattatcagtaatagagccaagcttagttatcaaaacctctgactttcaaacatataaagggttctttagttccaaactttttttttcctttctgaaatagggccttgctctgtcacccaggctggagtacagtggcacaatcacagagctcacctcagcctcaacctcccaggctcaagcaattctcccacttcagcttcctgagtggctaggaccacaggtgtgtgataccacacctgactaatttttttgtgtgtcgtggaaacagggtcttgctgtgttgcccagacaggtcttgaacttctggaattacaggcataagccaccatgcccagtctacctccagactttcagttatacatccttattagtaaatgatgtttgaacatataacctaatatatgtatgaaatatatttattaataagttatatattgtatatgtagtatacatatattactacattaatatgttattttctttataaaacacacaaaattgaaattgaaaggaaatcataacatagaaatagaaatcctaatgttttctttttacacctctatatcagccaagatgggctaggttatgtgtgttatcaactctcaaatttcagtggcttaaaacagcacaggtttatttgtctcatgctctgtgtccattgtggtttggcttcaacactcctctgtattgcatcgttctctgtattgttcaacaccctggcacccagactgatacagcagccaccagctggaggcttgcttgtcatcaggacagagggaaaaataatgaggaattaacacttaaagctttggcctagatttgacacatggcacttctgcatacgtttcattggccaaaacaagttatgtgttcctacctaatttgagggaagaaaagtcctaaccttgtgcccaggcagagaaatggacatattttagacagcattaaaagttgacacctctctcatgatcagttttggagaacacagcccaggatttgtgtttgtctaagaaaataaacacacaaagacaagtctatttagcttcttccattattttgtattgtttttaacacactgaagtcctgagtaatgagtcaactacaactacaggcatagtggcctctcttgcttacaactctgtaatggctttttagcactcattatataactcagacaccttaatatagcctacaagccccacctttccagcttcatctaactccactcacaccacaccttagaggcctcagactggcctttcagttccttgaagggagacatgtgctccctacttctgttttgaatgtttttcttcccttttccttgtttttgcccagtcactctgtagctttaagatcaaatgtttcttcaaggaagccctctctgactcccagagtacatcaagtcctctctgttctacactctcataataccctatactttgcttccagagaagccattccattttatgagtgtatttttgcactattctttgttcagtcaatttcctccaattacagtacaagctccaaagggtaaggatcaagtctgttttgctcagcactgtatgctattccttgtgtttagcccagttactggcatatattaagagctcgttaaatattgagtttggttatagttttatattttaggtctgtgacatttgtgtagtctatagagaacatgtctgagatatttatacagtccatagagaatgatgtgataagaagatgtaaatcacacaaactgcaaatacacacttgttctatgcctctatgtcttagggagtctaagagattccaaggtcagaatgtttttcctgttctctctgaattgaaatataccctcacaaagattttcactttctttaggtgtttttccttttctcactttttgagtgataattttttgtttaaattgagagccatacagtcaggggatatatcacatttaacataaatggcagtaaaactgcccaagcagtgagtgtattatataggcatagttaataaacaagctgtgtgacattaagctatgtttctctctagctttctggagatagtactgaattcccaaaacacagcgtgatttattttttgtgatagtgtgcatcagcaaaagggcatatattagatgcttggaaaatgctttgctatagatttatgtctttttactatttgtcttcatatataattattgggggcaactttagttttttctatttctcttttcagaaagaataacaattttttcgccttcttatctatatgtttcattgtggactatcagtactgttcttcatttaaaatgcaaatgttctaataatctacaatcataaccttatggtagaactgatacagacattgtaatctctaagcctctgaaaatagtgttctgcatttttattgtaatctctaagcctctgaaaatagtgttctgcatttttattctagaagagagctactgctcctcatcaatgagagagtgggattaaaaggaacatgagtaaggattatatttgcagagcctatctatttattcaacagtattgttgaataataacatttcttaagtatcatcttccctcaatatatgtgggggattggttccagaatcgccctccccccgccactgcatattccaaaattcatgcatactgaagtcccacagttgcttctaggacatcagccattccggtacttgggttttgtggcgggcaaatactatattttttatctgtggttggttcaaaaaaaattcacacataagtggaccccccacagttcaaactcatgttcaaggtttagctgtatctattttgtagcagaatctagggaaacttagaaagagaatgaccttttctatgaaacttaattttgtttcagacaataacattctgataagagctgagttttactcttttgttagcactgtcagttttctcaaccatagaatgagaatgataaaataaccatctcggctgggcacggtagctcactcctctaatcccagcactttgggaggccgaggtgggcggatcacctgaggttgagagttcgagaccagcctgaccaacaggaagaaaccctgtcgctactaaaaatacaaaattagccgggtgtggtggtgcacgcctgtaatcccaggtactcgggaggctgaggcaggagaatcacttgaacccaggaggtggaggttgcggtgagccgagatcgcgccattgcactccggcctgggcaacaagagcgaaactccatctcagaaacaaacaaaacaaaaaacaaaataaccatctcataaagttcttgtgaagagtaaataagatagtacatttaaagtacttaacccagcacctggcatacaacaaacacttcgttattttagatttactgtgagacttcgtccaaagttacctcttaggtatttattttcctctgttcctcccttcttatttttctccaaattgtcatcaaagataaatttctaaaacaaaaatctgattgtataactacctctttgataccatcttttcagctttgaaaacctttagtggtttcctgttgtctgaagaggaatgcctcaaatacatggatggtattcagcatcttcccacgtggccctagccttccttcccaaaccatcttctgccttgaccacccactgggttgcagcccaagtaggccacacagttttattttgctaccttggcttgttgtcttccttctgtctagaattcctgctgtgggcctcacctcctcatcaccccacaacctgaagaaacaactgtctatgggaaactcaaagatttctcttctttctaggcagaatttttggttcctgttcattcatctctttttagcatttattatgatatcaaaggtaattctatatgtcttgctctcttactagctcatgagttccttcagagcagaggccatagtttattcatcattgtgataacattgatgagtgccactagaactcagtaggcactctgtaaaaatttgttgaagtaatgtattaatatttggtttaattttattttgatttcagtgtgtttttattctaggtccttggccttgtccaaaacatgagtgttttccagtgtccaaaatgtaaacacaaaactcatatttttggtgctgatggtgcaaggaaactagcacagacccttggtcttgaagttctaggtaagactgtgggatgttcttttgtagaagaagtggcagaagagaaagtggggatgaggcttgatgattaagagtgtctcagaggccgggcacggagtctcacacctgtaatcccagcactttgggaggtcgaggtggacagatcacgaggtcaggagatcgagaccatcctggctaacatggtgagaccctgtctctactaaaaatacaaaaaattatccaggcgtggtggcgggcgcctgcagtcccagctactcaggaggctgaggcaggagaatggcatgaaccctggaggcggagcttgcagtgagctgagatagcaccactgcactccagcctgggtgacagagtgagactccatcaaaaaaaaaacaaaaaacaaaaaacagtgtctctgaaaatgatgagttgcttttggctttgtgttttaaattaatatagcacagttctatgtgttaacctttctttggcttttttgaataggtttgttctgtcaactatgataatttctattttaaataaaaactgtctataacttaaatttgagaatagagttttgtagtccaagtactgtaatttgaagccatattttaaatgatactcatcagtgtgtttgctaagttgggtgtacatctctcagtagaaacaggtacattaaaatgtctgttccgtatgttgtaaaaacctctaaaagtgttcgttcttagtgcatatgtaaaaatgccttcctgattaattctttgttagtctttctgctttagaatggcagtatttactgttttctgtaatatttaatgtgtttgatatgtctttaaaatatggcacctgaaatttacattgtacgcactgttcatggcactgaactgaagagttcattagtgctgtgaggaaaactaaaatcatgtgttaaataagcaaaacacaggttttggataaaacatgatgttccaaaaatccacaggcaacttaacagactttttagaaaacatgttttgatattctaattgtgaatgggtttctgttcttgccaaaggcaggtgttagatgctgaatagggaaggcataaagtgaattattagacttaggtagttaaaaattaagatccctagagattaaggaatttcaaaacattctctgttataattaagtttctaaaagttgatgttaaatatattattgttatgcatttgcactatagcagccactacaataccaggtgaatactaatgatatattttgatacattgctataattatagccactaattatattctgcaactgtttttcatttaacccagaaagttcaattttccaaatctgcataataacagattgacattcgcttatataataaagtaaatgtgtaattataatggcattattgaattatactgacaacattgtaatttcctaacttacaaatgagctgaacaatttcctaagtcagttatttagaatttgaaacatttcattgagaaacaatggtatgtatggaagttacattttaaccaatggctcacagatgtacaattaccctaaaaatgtatcaaaaacactgactactgatcacaaaaatttgatggtgccctagactgctatgtctgacagtgttaggggaaaaatcatttagaattcctcgttagggcacgtcccctccttttaatgtagtcatgggtcccatggtgtctcccatgaagtggagcagggcttcaattatgaagaggttggaattgggaatgaggaactgaaatcagggaaaaagctttcacagctctggcctcttggccagttgaacctcctgggaacccttatttgtcctttactgactccctggcagactcttaattcagtgggtcgtgttttaaatgattatttggtacgatagctcttgagaaccttatctgtatttacctacagggacagtttatgcatagtagttaaggtctcagaccatctcacagaaaaccctttaacctattatatgtctgaaatgtttcctcatttctttcagacttagcacctcaaaaatacttctcaggctcagactgctcctcactcacttttactttttaaaaatccctgtctagatacaacaattagcccattaccattcttactacgcacctatttttaacaagatttttccccttcttggtctaatcttctgtgtctgtaggtaggattgtgagtatctggagagcagaaatgatgtcaatagatggctatataaaggtgaaggttttactcttttaccttccatttctgcagtagaaaagaaatccttcatgattctttactagaatgacagttcataaattgagaggaaaaaaatttcatttctaagcattttctataacatttttgctgcttgctcctgtgacagtttcctatagtccgaagttgatctagagaataggaatcaaatttaatgaaaagctgatccttaaatggttactaaaatatcatgtatttgtcatttggccgttggatattgaggacttatagtttaagatcacagcatttgacaagaggatcatgaaataacatttacttttccatgtacttcatagtatatactgtaatatttttataacatatacttcattatttaaatttcctgacatggtgctaaatgacttatttgaataaagcaccacatacacgtatgttttaataacttttgcatggatttggagtggttctgagaacgctaagtaccatggcaagtcaacttttccgcttaagactccactcactgtgctttaaatctcagtcttgatagacttcatttgtgatagtgtgctggaaagagtatattggatgaggggtcagaatttaggtcagctcctaaattccactgcctaatagtaatgtgtcctcaagaaaacacacctctcccatctcagtctgtattttggaggttcttatcatatacttgctgagatctcaccaagctcacaagttatatatggtgctacataggttagtaaataataagagaaaaataattctgtctgataaagagacagatagttgagataacaggtctggcctacttttgaccagttctttgagctcactccatttgccaacatcaggaaggttattttgttgtacttttttttgaactactttgcctccccatatttttctcttcagtttcctcttattatgtggcatgatgtgtctatatcagatattaatgggagaaatcatttgcaaatgtcttccaagccattgcttgcttggagacttccagcaaagaataaatcagaggcctcataccttgatgtggtgccacagagctttcctatataaacatacaatcactgtactactctaaaatagagtatcttgtttgtaattcccatttgaaatttctttttcaaagatttagcaattagaagatagtcaatttgaatcaatttagttccgattttgtttctttccatagttcaaatagtgagattcaaaatgcctatatgaacttttctggttctaatggatgtctgctgggctcttttaggagacattcccttacaccttaatataagggaagcttcagatacaggccagccaattgtgttttcacagcctgaaagtgatgaggtaagttccatttttggatacatatttttatttctttttatgtacttttgaaatacagaaagaaagttgggaagattaagcgtttatatttgcagtgcatatatatttaaacaaggattatttaacttgtccaaagcatctttaagttactgtcatgtacagtaagcttccagtgctggctctaaattatcatctaaacaagtttacctacagagaatcatcacccaaccagttttctcaagaaaagcgtgaaaagagagtttgtaaaattcttatattgctggctagcaatatctaactgcccaagattattatatttcagtattagaagttcaactgattggagaaggaagcctaatgcaagaaagtattgaattggatataaggcaattgtgtaaaccattagaggtgggatttttttttctttcctttttcttcagacagggttttgctctgtcacccaggctggagtacaattgtgcgatcccagctcactgcagccttgacttcccatgctcaagcaatcttcgcatctcaccctcccctcccgagtagctaggaccacaggtgtacaccaccatgccctgctaatttttttttttatggagacagggtctcactatgttgtccaggttggtctcgaactcctggactcaagttatcctcccatcttggcctcccagcatgctgagattataggcatgagccaccatgcccagcctagagatgaaattttcattgcatttattttaataaatataactgggaaggtgaggtgaaaagactagtagtgtttcattagccaacatagttggagatatagttgatagattttcaaaattactgccacataaaatctttaagcataaaatattttaatctttttaaaaatagaaataaaattaatcatacatattttttctttcctaaataacacttgctatttaacttggaaactgaatcatcatctggcacatcagttcagatgttgttcctttgttgaacagccccaatcaatcttctaatagtttttctttttttttttttttcttttccttaactaatgggtatagctttacagtactggtattttttccaaacataactgctgttctttatattctagtttgcttcctttaaccttctgtgaattggaaaataaaggagccaagtttggttagagctgtaaagtaagagtaaatgaacagtaatcttggatgagtaaagtatattcattttgagtgatctgttttctgcgtttagaggtcctttccttttcttaagagtcagcagctatggtataggtgattgttttgctggcgatatgatctctgagtagatatggtataacagttaccattatttttctcttctctgtcttttaggtattaaatgttaaatttccttttcagtctttctcaacaatttttcagctaagcaaaaaaccataatcctttatcatcttggtaattaaagtctgccaatcccaactaccatagctgtactttatgcaatatatgaaaaagttctttgaaaattgagggttttttttgctttaattacacacttttaagtgcctcctgagaacagactataaagacatttcacagtgattcctagtgaataagaataatttcttatcagtgtatttcaattaagagtttagatttttattatggttttcacctgttcattattttttctttgaaatcctccagaagtaagaaacatttcattgaagttagaggaatgtaatataacagagaacatatagccaccatccaaagataatatgatttaatactctaaatagctttgttagattctcgaaggggatctctgcatggcaggaagagcactaaatctgagtcatcatggggtaccaagtttgccactttcgatgtgtgacctaaagcaagttttctaacctctctgaacctttctctccatctataaattgatgtcataatgaggaagatgagaaagaataaatgaaataataatgtgaaaataccttgaaaaatgccaagtagaatataactgtatttaccttctgaaactgcctgtataagatgtcatgacactaaatgtctctcctcttccctttgctaaagagctgagtccacttagtgtccttgacgtggtatcaagtaaatatcactctttgatgttatttaaaaatcaaagtaggcccggcacggtggctcacgcctgtaatcccagcactttgggaggctgaggcgggcagatcacgaggtcaggagtttgagatcaacctggccaacatggtgaaaccccgtctctagtaaaaatacaaaaattagctgggcgtggtggcacacacctctaatcccggctacttgggaggctgaggcaggagaatcacttcatcctgggaggcggaggttgcagtaagccgaggtcacgccatggcactccagcctgggcaaaaagagcaaaactccgtcaaaaaataaaaataaaaaaatcagggtagcagcatttgaatcatgagagaagaattcccagcttcaacatcaaagacattaactcctagacactaagaagctgtgattgaggcctaggatcagaatcctccagttagtcttgtgatgaatcttgcctcctgaaagcctccttccctttcccccgtgaactcaaatagaaatgtgctcttagaaactagtcacaacgctctcaccagattctgttgtattcatagaagcataatacctattctgcctgcatgtcttcatttaaagaatgaaggaagtgtttatttgccaacatgataaaacttctgcagaagttaatggggcaaaacctataatgttatttgttaattatccactttagactgatactgttgtgttgtgttgtgttttgttttgttttgttttgttttgttttgttttgtttgagacaggatcttactctgtcacccaggttggagtgcagtggcacgatctcatcctcccaagtagctgggaccactggttcacaccaccacatccagctaattttttgtgtgtttggtagagatggggtttcaccatgttgcccaggctggtgtcaaactcctgagctcaggagattcacctgctttagcctcccaaagtgctgggattacagacatgagccatcacacctggcctagactgatactttttattgtttacttttaggggttgactcataggcacgattataaatcagtaaacgtttaatcgttagctttttgtcttccttcttactccaccttctccattttctatcactccatcctcccagcaccaggtgttagggctcttattctctgcccacaaaatcctttagaattacacactgaggatttaactctcccagtaacatttaactttcagaagaggcaaacactaaaaaggtagtgattaatttaaagatatgaattgtggtgaatttaagacatcattggaaatgttggaagagctgttagtaccaattaaaaagtactaatagtctgctgcttgctcagacaatgggcaaaaccttctgcacatgtacaccacttaggaaaggcaagtaagactccaaatgtgactagtgtaaagcagccaaagaaaacaatagaggaggggtgagaaggcgatatttagaattcagaacccctaaattcaatagcatccccgcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactttattttcttacaatttctaaattatcacctcacaatcttaatatgaaatgactgtgtatgataaattgggacttcaaatatttaaaaacaaaaacaaaggaaaagacctttgtgcactttggttaccattcattccctgttgctagttaatggcatagcggacagtagggtccaactgtattatctgtgcctctagatgacctaacaaaaagatcttgaataggagaaaagggttagtctgtgtagagttgatgaaagaagagagtattaatagtttgagttatctcagttatgtcctttacatatgatatgtgtgtgtgttacttttttgctagttatggattaaacaaaagaaagatagatttgatttaattattcctcaggtgggaacagtgcccaaaggacatgttcatatgagttcttcaatgagattataaatttcttgagactataatgataataacagcagctacagatatttattatatgcttcctctgtaccaacaattcacatgccatattctcacttaatactccgaaaatgctttgagctagatataattattataaccagtttacagatatggaaactgagcctagaagggttgagtaacttgcccaaagcctcacagctggtaagtaataaagccaacattctaaaccatggctgtctgacttcaaggccccaactcttcaccaatgaactgttctgcccctcttttatatcattacacaccacagatttcccaacacaatgccttgcacgcaatacaaaccaaaatgtatttgttgaaataaaactgcactggctaaaaaatttagcctcaacagtttttgagaaattgaaactgttaaactaagcactttcagtggtttctcagcaactgacaatctattactttgaatgtgatatattagaagtcaaagtttggagatagtccattaaaaaggaaaggttaaatgtagccaatttgattgttctggaattattcagtattttttgtattctgataggtttatgtctctaatgtagataaatactaaaagattacagaatgatggccttgtctcatcttgctttagtgaactttaaattttcatcacaaaatattaggcataagtacctagaaaagctactaggagataaaaggtatttataaagatgtatgggtgaaaatcagcacatttgatttgagagaaacctttctttataagtagatgttatttctatttataaacaaaaactattgtttctgttaactacagcagagaagaacccatttttagactatgctttatgattataattacttgtatttgggtttactgtttaacatgtggtgtagtggaaaaagctggactttagagtcagttggacccaggtttgaaggttttccagcctgacttcatgaccttgagcaaataactcctggtttcatcatccaagttaagctgatgatgcttgttttacgtgtctaagtgagattatttacatgaagtacttggtatagtaggtactcaataaaaacatttaaagccttattcatgtttttagagttttttttttttttaaggactctcttaaaatgacttttaatacttttctggtaaaataaatcatgatttagctgttagggctcaagcatagtctttaaaaatgaagacatgcgaaacactcttaaagcacttcatcaagtcagggcaaatggaccacaaacatctctttttactgtgcagagtctgggaattggtcagcttaggttcaaagcccagctcatctcttactagctataatgtttttgacaaaattatttacctttctggatgtttccttatctgtaaagtcgggataatgatagaatttacccccagagtaactgtgaagataaataacacttggcaaatattaagtactcagtaaatcttagctgttttcattagttgtatataaatatataactgtaagcatattattttattcgtttgttttcacactgctgataaagacataccagagactgggcagtttacaaaagaaagaggtttattggacttacagttccatgtggctagggaggtctcacaatcatggaggaaggtgaatggcaaggaggaacaagtcatgtcttacatggatggcggcaggcaaaaagagagcttgtgcaagtagactcccattttttttaagctatcagatctcatgagattcactgttatgagaacagcatgggaaagacccaccccatgattcaatcacctcccaccaggttcttcccatgacacatgggaattgtgggagttacaattgaagatgagatttgggtggggacacagccaaaccatatcactccaccccagcccctcccaaatcacatgtcctcacatttcaaacccaatcatgccttcccaacagtccccgaaagtcttaactcatttcagcattaattaaaatgtccacagtccaaagtctcatctgagacaaggcaagtcccttccgcctatgagcctgtaaaatcaaaagcaagttagttacttcctagatacagtgggggtacaggcattgggtaaatacagctgttctaaatgggagaaattggccaaaacaaaggggctacaggccccatgcaagtctgcaatctggtgggacagtcaaagcttaaagctccaaaattatctcccttgactctatgtctcacatctaggtcacgctgatgcaagaggtgagttcccatagtcttgggcagctttgcccctgtagttttgcagagtatagcctccctcccggctgccttcatggtttggcgttgagtttctgcagctttttcaggcacactgtacaagttgtcagtggatctgccattgtggggtctggaggatggtgactgtcttctcacaactccactaggtcatgccccagtagggactctgggggctctgaccccacatttctcttctgcactgccctagcagaggttcttcgtaaggacctcgcccctacagcaaacttctgcctgggcatccaggtatttccatacatctgaaatctaggtggaggttcccaaacctcaattcttgatttctgtgcacccacaagctcaacaccatgtggaagctgccaaggcttgaggctcgcttcaccctctgaagccatggcctgagctcttcattggcccctttcagccatggctggagcagctgaggagcagggcaccaagtccctagtctccacacaacacggggactctgggcccagcccagaaaaattatattttcctcctaggcctccagacctgtgatgggagaggctgccatgaagacctctgacatgccctggagacgttttccccattgtcttggggattaacattcggctcctagttacttatacaaatttctgcagcaggcttgaatttctcctcaggaaatgggattttctattcctatcacagtgttaggctgcaaattttctaaacctttatgctctgcttcccttataaaactgaatacctttaacctcttgaatgctttgctgcttagaaatttcttctgccaggtaccctaaatcatctttctcaaattcaaagttccacaaatctctagggcagggacaaaatgccgccagtctctttgataaaacataacaagagtcacctttgcttcagttcccaacaacttcctcatctccatctgagaccatcttagcctggaccttattgttcatatcagtatcagcatttttgtcaaagccactgaagtctctgggaagttccaaactttccacattttcctgtcttcttctgagccctccaaactgttccaactgctgcctgttacccagttccaaagtcacttccacattttcgggtatcttttcagcaacgccacactctactggtaccaacttaccgtaatagtttgttttcacactgctgataaagacataccagagactgggcagtttacaaaagaaagaggtttattggacttacagttccatctggctaggaaggcatcacaatcatggaagaaggtgaaaggcaaggaggaacaagtcgtcttacatggatggtggcaggcaaaaagagagcttgtggagagagactcctgttattaaagctatcagatctcatgagacttattatcacaagaccagcatgggaaagacccaccccatgatttaatcacctcctactgggttccttccacaacacatgggaactgtgggagttacaattgaagatgagatttgggtggggacacagccaaaccatatcaattatcaatgtagaaattaatggttttagaaaattttactattgtgttctacagttactttttatgaataaagtagaggatataagtaattttgcattacatttatttaaaggaactcttaaaatgcaaatatcattaccatgcaggcattaggttagcttgtggcccactctgtggcttaagagctgctgttagtgtcccatgacactgggatcccagacataaagagtgtaacaatggaactaggattttttgcatgatatccattttttaccaggtgaaagagcctataggtgcttggtgctggtattacacaccattctcggggagatgaagaaaatgctttcctaagataaactgtagcatggtaataaatagtcctccttaaaatgactaacagctcttatgctaaagaagttttggcagtctctaactcaatatatcaatttttcagagcaaaaaggtgtaatctctctgcaactagactgggttgctagtttgctgacaccagaattagaatttgaaaaacagtaatttctggtactaaatattacttcagagtcaccttccaaataattaccctccaaataatctaaaattctttcttccttgtgccgcctgcaatatatacagcactatcttctcaatactgaatttcctcatctcactcagcctttttactatcaaatacagtgggcctctataacaaacagttgatgagtcattcaatgtctgctgaagagaaatacagaacaaataagtttgttcttttccaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaa

SEQ ID NO: 1344 - DNA, 397906 bp, Homo sapiens; identical to SEQ ID NO: 959

SEQ ID NO: 1345 - DNA, 397906 bp, Homo sapiens; identical to SEQ ID NO: 959

SEQ ID NO: 1346 - DNA, 397906 bp, Homo sapiens; identical to SEQ ID NO: 959

SEQ ID NO: 1347 - DNA, 397906 bp, Homo sapiens; identical to SEQ ID NO: 959

SEQ ID NO: 1348 - DNA, 397906 bp, Homo sapiens; identical to SEQ ID NO: 959

SEQ ID NO: 1349 - DNA, 397906 bp, Homo sapiens; identical to SEQ ID NO: 959

SEQ ID NO: 1350 - DNA, 397906 bp, Homo sapiens; identical to SEQ ID NO: 959

SEQ ID NO: 1351 - DNA, 397906 bp, Homo sapiens; identical to SEQ ID NO: 959

SEQ ID NO: 1352 - DNA, 113475 bp, Homo sapiens; identical to SEQ ID NO: 967

SEQ ID NO: 1353 - DNA, 58605 bp, Homo sapiens
agatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagaaggctccctggggccccgcaacgcccgcagccagccccccaagggcgcgtctgatttgccaggtgagcctccggccgagggcgcagcgcacacggccagctccgcgcaggcagactgcacagcccgccccaagggtcacgcccaccctgctaaggtgctaactttggacatctacttgagtaagactgagggggcacaagtggacgagccggtcgtgattactcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctcggggtatctgcattgtggaagaaacgtctggtcactgaactttcccctccatgctgaacttaagatagtgaagggccagtttacacagtcaagatttaagatgacacctgtggcagcctcctcagttaattccctttttaacacaagatttaagtttaacgaatgtaaaaataggatatccgttgaagctcaacgtttatgtagatgagagataagacctcatggcctgacatgagctgattctattctttattcaaaatgtacaagggtgttccaaggtgggatgttcttaaaatgcatgtgctgtgaatttcaaaatatggagcaaacagtaacatgttaaatacgatccagtagctttgacatgtgtgagttttaagagaatttgcagaaccttttatggcactcagtgcatttattggcaaaaagcttaaaaacacacaagaaaagttcctaatacaagtatcttggttgcttcttcccctttataatgttagggagtctggtgatacttttggacccaggctgaaaagtagttttcagttactgaaataaagatcagtgttcttactggaagattatttgctacatgaaagcagctgtgacaggtgtgagtttaagataattccaaaacattttatggaacttagtgcattattggcctaagcctttttcaaaaagtccctaatttatgtatcttggttgcttcttcctccttgtgctgcatgaaagcacaaaacaactgtgactacttgctgttaagtttattcatttcacaagtaatttatttaatactttctgtgcaagatattgtgctagtcactgtgggggaaaaaaaccctacaactgtgactcaggatattgccctgaaatttttatagccccatctggcacacaaaaagcacacaaatcaaataacaatacaagatgatatctgatgaaactgccaaacgaatgttaccatctgtaaatcctggggaagtgctagcgagcaagaaatcactgctggtgctttgggggagctgggccttgtgccttgatgataaatgcaatttgtataggtggacaggatagggaaggtactctatgaaactgataagaccctcccttctcacacttctgctccctcaccactcccacttagcacaggtgaataatgattaagtgcttaagtttttcctccattcacatatttgttcaaggagtgggtattttaacaacattatcattataattcttgaacctaatggtttctttcattctatttgatttcttggataagtaagcttaagaggaggagagttctgattgggagaactctgagaactctgagagggaagtatgcgtaatgaataacttgactacctcaccaactgccaacctggagacctttgatatagtcagtgatttattctgtgatggtaggtagcatcagagaaatgagctgggtgaatgatgcctattatttatagaagaccagtgtgattgaatgctaaagcctcctaaatgtgagccttagagaaacattgctgtgtaccttatgaaggatggttcacctgtcttccaattagaagacaccagtagaaaaaccagaaatgttacactgtgaaatagtaggctaaacaaacaggaaagatgatcttataatgaaattcttcgtttgctgttctctgtaatagaactaaaccaaatatgtctttcccagttctgattaatttatacctaaaaattttctttaccagacattcaatgtatttgttttgcgcagtgccttgcacatggtcatttggcaaattattgacttaaaaattaataagtatttctagtcctttgacccatttctttgtgactgatggttttttcagaccctttaattcttcctatgaccgtatcgcaagatgttaatcagattattctttaaaacaatttgagactgaagagtaagaaaaactatttcgtatttcctgaaaaatgacactgaagtagcatgttcctttatgctgttagaaaaattattacttcaagttctctaccaagtgctgaatgttgaaattcttaaaatggtatatgtagaataaggagaattttcctcttataatataactatggctttttggactccaaattattttcccctgtctcataatgaaggcattacaacatgaattataggagccttccttttaatcagtctgaagtaggttaattgtagtaactcttggtagcacaacttaatagcacagaaagtttggttgtaaaatttattctgatcttcgtgtaaatctttaatgtgcagatacgtgtttcctgtccttaaggtagcctgttggctaacctgtagtgttttctatttacatcataagatatacttcgatgtttgaattgagtacccttccttgaaatgattagtgagaatttttaaaaagtatattctctggtatgtgaccatccctcattaactgatagcaaattgaagctctctatttctaatcatctcactagtttcataatttgatctttgaggaaatgcttataaattaattttccttttaaatttaaggtatgggcctgcaataagggagcctaagtatcttatggagatattggggaaagcaatgcctgggagaaatttatgagcagagatcaaatttatttatttatttatttatttatttatttatttatttatttatttatttttgagacaggatctcactctgttacccaggctggagtgcagtggcatgatcatggctcactgcagtctcgacctcccccggctcaggtgatcctcccacctcagcctccctagtagcagggactacaggcgcaccaccatgtctggctaatttttgtatttttttagagacaggattttgccatgttccccgggctggtctcaaactcctgggttcaagtgatccacctgcctcggcctcccaaagtgctaggattacaggcatcagccactgatcccagcctcaaatttagtatcaagtaaaatttgtaaaaattaaaatctgaattctcagtgctgcttttggagagaatattttatccagaaggataagttgactcaccagcagtcatactgcctgtcccttctagaagctccttaggcccaagcttctttttttttttttagacagagtctcactctgtcgcccaggctggagtgtagtggcacaatcttggctcactgcaacctccacctcccaggtttaagcaattctcctgcctcagcctcccaagtagctgggattataggcctgtgccaccacacctggctaatttttgtatttttagtagagacagggtttcaccatgttggccaggctggtctggaactcctgacctgaagtgatccacccgctttggcctcccaaagtgtagggattacaagcatgagccaccacacccagccaggctcaagcttcatgaaggccaagtccatgaaggagaggcagtatgggatttcagtgtctccacttgtgtgttctcattatcaaagtggcctctaaagtctatgttatgttatggatctcatgataattcactgactttaaatgataaagatggaaagaaccagaggagctcattcaggcgggtatagtccaagcctatctggggaaccagaatagtatagtggttgggagcatggcatctgaagccagagcacctcacttcaaactgtggccctgtcacttatcagctgcataacctcagggagttacttctcaacacttcaacttcctcagccaaaaatagaatgtataaagtcgtatattaattaagtaagcccgatgaagcatttgtcaagggcttgacaatcactgattgttagtggttatgctttatctctcccgttttataaaccactggactaatggtttagactttttttttttttttttttttgagacagagtctcactttgtcacccaagctggagtgcagtggcatgaccatagctcactgcagccttgatcttctggactcaagtgatctcccacctctgcctttggaatagctgggactacaggcacgcaccacttcacctggctaatttttttgtttgttttgtagagactgggtctcagtatgttgcccaggctggtcttgaaccccttggctcaagcaatcctccctccttgacctcccaaagtactggaatatatatatacatatatatatacacacacacacacatatatatatacacatatatatatacacacacatatatatatacacatatatacacacacacatatacacacatatatatatatacacacacacatatatacacatatatatacacacacacatatatatacacacatatatatatacacacacacatatatatatacacacacacacacatatatatatatacacacacacatatatataagctttggaatcctttcttctaagaaagtttaaataggagcaataaataaaacagatactaggagtgattctgcttgaaaggagagtggacagccccatcctcatccctactttccccaactgcagcccttgaagagaaccccagggattccttcaaccataagttgggggaaataaaaacaactctgttctaaaccatctcattttttttaaagatgaagaagttagagtccagagaggtaaagtaacttgaccaggttcacacagataattagcataaaagccaggaccagagccagagaatgccaaacagagcacattttgtttctctgaaagaaagcactgtgtacattcaaagacttattatttccactgggggtaattatacccaagaaatgtgacggagagaggggagactctcttgcccaagaagtggtgacaaaaccaacagttgcataattgataagtaaatgacggtacatccatatgatggacttccatgcagcattaagacaacttttcaaacaaattttttggtaatctgaaaaatgttaactataaggttaagtcattttatttcttgaaaaagcaagatatcaaattatatgaacagaataatctcaattctattcaaaatatttaattatgcatataaaaagattagaaacatataaaaatgttaacagggatattgtctgactggtaggattatcagtgatttttaaatattatccaaagttgctatagtgaacacacttataatcagagaaaatcttatgggggaaggatgagatgaataaaatatccaaagcggtcaatagtagatgaatttttaaaatctatccttttgagataatatttaaaaagttatgctaaaataaaaatacataattgatgttggagcatgagaatgcattaaatatttaaatttcttctaatgttgttcaggccttaagatgtcttccaactctagtgccaagcactgtgcatacatgctacgtactcaataaattagttcatccctcatccctagagtttcttggctatataatcttccgatccctcatatgcaagcaaaacacccattaaaaatagttggtagtgtacttaggactatttaaaaatagtttcattaaaaaacaaatgtggcagagaatggtggctcatgcctgtaatcccagcacttggggaggccaagatgggaggattgcttgaagccaggagtttgagaccagcctgggtgacatagaccccattctacaaaaaaataaaaataaaaaaattagttgggtgtgtgatatgtgcctgtagtcccagctacctgggaggctgaagcaggaggattgcctgagcccaggagttcgaggctgcagcaatctatgatcacactgctgtactccagtcttggcgacagagcaagaccttgtcttaaaaacacatgtgtgcgcacacacacacacacatacacacacacacacaccacactccaaatgttatatatcagggagatgttggcttttcatagttttataattaattggtttgtgtgttcactttttaaaactaggtcaataactttatcttcctgctttttcctcacagccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatggtaagtagcaatgtgttattatttatttggggtatttttaaagcaagggaagagaaggatgatgagcaactcatgttattcttttagaaatggttaagcttatgtgctatagtttttattcattcatcacatatttgaaaacctgcaatgtacaagggaccgttagagtgcaagaaaaaaatgtactaagagtcttcactgaaggcatctgtagtcttgcagggagataaagctacaaatgctctaaggcacatgatctttttttttttttttttttttttttgagacagagtctcgctctgtcgcccaggctggagtgcagtggtgcaatctcagctcactgcaacctccacctcctgggttcaagcgattcttctgcctcggcttccctagtagcagggaatgcaggcgcgtgccaccacgcctggctaatttttgtatttttagtaaagactgaaaatacaaatacgggggttttaccatattggctgggctggtctcgaactcctgacctcgtgatccatctgcctcggcctcccagagtgttgcgattacaggtgtgagccatcctgactggctggcaataaatcttttaaggcacatgtgaatttatatgttgtattatgaaaggtataggtaagcttttagagttcagagacagatgagttgctttttcttacctattctatgtaaaaatgctcagtgctatacttagaattttgaagatttgtgaaggagcttcctctatttgggaagtccccagccagggaaactttttcttaatccttctctctgtgagattcactctttgttcccataagtagcaataggtgtttatcctatgcaattgagacagtattttgtctttattgggaattagttttcattagggaaatattttttttaccctgcaaagctgtggggaataaagaattttggttttcattggatcttttcttaaatattagagagaagacagcaaaacatgattttggggaataattttgatttctgcatcttcttttatctcacttcagaagatgtttactttactcggtttttgatgtgaattgcgcctttttgttaccaagcttatttaaggtgagaaaggactatgagagaggaaggtggaatatatgtttagtgatcagctctgccaggctagaaacctgagtagggtttgtattctggtggtccatcctgtgaacccggctgtctggcaagtgtggacctcaatccaacacagtttatctaggcagaaaataccttgcacctttcctcgtctgtacagggtactgcagcatggttcaatgtattgtattggcttttactacaatcctgtcagagaatgtgatgttgcaagctctttcaaaatatatggttgggtttccagcagaggtgcagatccctttttcatgtgatttcataaactttcataaagtttgggtttcagatgtttggtgttaggaccctttatgtttaaaaatgattgagaaccccaacgagcttttgtttgtatgggttctgcctatcagaatttattatattataaataattgctgagaaaattgtaaaacaccagaaagtagaagtgcacactgcaccagtgctcagagcaacgatgtcatcacacatcatggagccttgtactccgctggacatttgagacagagatgaaaaaggcaggtgacctcttcttattatgaaaatagttttgaccccatggactacctgaaagtatcttggagacccccgcagtggcctctgaaccacattttgagaaccactgctataaacaaataagactgaatcagcctatggtactcagaaatcataaaattctaactatttctattaatagttatataatagaaatattaactatttctctcaagcacaaaatttccactggtccacttcccattcattactactttgttctttttaattgttcttagatcgctttccttatttaactacagtctgacaaagttgataacagaatatacagtttccctatgaaaatcaagtcaaatgacataaaaaggaaaaataaaatctttatactttttctaggcctttttatgattaaaaaatatggtctttctttaggtcctgggcttttattgattgtatattcaatcatgaaggttttacctgaattttgttttaaattttaggctttttcttcagtttatctacttctaatgtgtatatatacataaataggtatataccatctggcttctgataaggctctaggggggcccttatggcctttttttttttttttagagtcagaatctcgctctgtcacccaagctggagtgcagtggcatgatctcagctcactgcaacctctctgccttccaggttcaagcgattttcatgtctcagcctcccaagtagctgggattataagtgagtgccaccacgcccagctaatttatgtatttttagtagagacggggttttgccatgttggccaggctggtctcgaactcctgacctcaggtgatctgcccacctcagcctcccaaagtgctgggattacaggtgtgaggcactgcgccccagccttttgtggtcttctgggcatatcacactctggtgtgatgcaagagcagtcagagcaaaggcagttcctaaaataggcatcctggtcagcactgaaagtagttcacgttttgtaatatttttacatgtataattactattttattatcttatgcatttctggttttactggtcttgtcagatggtcttgaaaatgattagttttggagccatattgaaatgtattttgtctatcaaaaaagcgggattaggccgggcacggtggctctcacctgtaatcccagcactttgggaggctgaggcaggcggatcacgaggtcaagagatcgagaccatcctagccaacatggtgaaaccccatctctactaaaagaaaaatacaaaaattagctgggcctggtggcacatgcctgtagtcccagctactcgggaggctgaggcaggagaatcacttgaacccaggcggaggttgcagtgagccaagatgatgccactgcactccagcctggtgacagagccagactccatctcaaaagaaaaaaaagggggattaaatatactatgtgcaatgtacattatgaaatataccatatataccataaacacttctatttagactagtggttgttatatgattgtagatttactatgagaaaacaatatttatatggattcagatagggtatgtatatgaacacaaaattgattcagctctttctaggtaagtgattaatatattctaatttatctttatttgagatgatactgatattatttgaattagaatctcttagctgagttcctattctgtgaactgacatgaaacatatgtgccctgaattttctagcattggtggaaatagcctagacatttaaattaggagaaattgaaatggcaaattcagttagaggtgaaaaaacctcaatttaaaagcataaactcaaagagttttaatacaactttagcatccattagagtggaggtttcaaaatcgatacaatgtgggaaaagtgtgatctacctacaggatcgtgggtggaaaaagaggatcgttatgtgaagttgtaattatttgttgtgtttttgttcatctgattgcagacacttagaggaagtgtccaaaataaactcaatccccgacctggaaaggtaagattattttctgtttctagtcttgattctattttggtctgacagagtacaacaaagtgtgctaccactttcgttttcttgcaggtagtgatatatagtgaacccgacgtctctgagaagtgcattgaagttttcagtgacattcaggattgcagttcttggagcctctctccagtgatactcataaaagttgttagaggatggtaagaatggcactttaagttcctgatgtcaagtgtttgagttttacatacttaattaactttttagtcctcactactagtttaaaattatggctttagcaatgaaaagcacaggaaatactactcgtggtaagataagggattcatatcttaacaatgtcattttaaatcatgtttctgattatagcagtgatatatgtttatgggagaaaaatcagaacaatacagtagaacaagcttctttttcccatgcttccccataatattgttttggactagtcatatatcagggcccataacatactcttggttgatgacctttaaatgaggttgataagaattgcactagttatgttgataggccagatacgacttttcaaaaacctataaggaaacttgagaacacgtaggaaaaggcaaagtaaagaaacaataaggaaaaaaaatctataaggtaaaacaaaaataatctataaagaaaggcatttttctaactttttaatgacagttcaatgcagcactaacttaaaatttaatttactttccaatatttccacaaaagattgttttggctaagtaaagaaactggtgaaaaaaataaatattttgacagtttctgaaatcattttatcagcttcattgcctcttggagatacacaggaagttgggtagagaaaggcagcttaaaaaaagaaatcgctgatctggcataatagttatcttttggtgcctacttgtaaacttgtttgaagtaaagagggtagacctctgaatgtttatggatttacaaattcataagcttttcttttggtctccatttgattaaatatgcagcagctttcctattagatttttaggtgttttaatattttttcctatatatccaacatagtcatgagaaaaacaagatttgcttttattcttaaatttgaagacaaatgctattttaattgctagagaattggccactaatatacaatatataatagtggcaattttttacacaaattttgtttttatggaacagtactttttcctttcttttgcaacttttgtcggcttctttttcttgaaagcataagcatttacactgccatatattgacatgaggtttttctttagtgtttggctgttgttgggaagaatattattaaaatgctttccattaccatatctatagtcttttgtgccaacatattcattgatatgactgtaatatgtaagttaaagtctctctaagagaaatgttttctacacatataaggagacaaaaggccagacatggtggctcatgcctgtaattccagcacgttgggaggccgaggtgggcagatcacttgaggccaggagttcgagatcagcaggccaacatggggaaactcagtctctactaaaaatacaaaaatcagccaggcttggtggcacattcctgtaatcccagctactagggcagctgaggcaggagaattgcttgaaccagggaggcggaggttgcagtgagccgagatcgcaccactgcactctagcctgggcaacagagcaagactctgtatccaaaaaaaaaaaaaaaaaagagacaaaaaaaaaaaaacctagtacagtaaacatccatttatctgacatattatcataagtctctaccacttggcaattacttagaacattagtagctctatagcattcatataggtaactccaaagttctctaagatcctgatatagttcatgagttatcagaggcttaattatacccagtaaaatattagtgttagggagagtttaagctattttaattgctagataattggctgctaatattctatatatatatataaaatggcaattagccaggttatttgagtaatcaaaacctctctcacgaagactgactaatggttttgctgtgttttattgttagttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggtaggttgtggtaaatatggattttatttattcagctaatatttatggattcttactttaagggaaatgatcattttacgaaatatgtgattgggaaacatatttggtgccttatggatatattttctgtattttaagtatttgtacactttaaataatttaaaaagaaacataattggttagataatttttcacaataaaccctttaggtagatcttttatgcctgtccttctattcccatcttccaaatatattttacctggtaacttggtttaaatgagttctgcctctatgaacaggtttttcatttatttagtgtttttgtttgctgtatgagttctgattactttgagtggtttataggaattctattttggaaaaataaataatccaaaaataatttggttgattaactctgggatttcatgtgggtttaacaaaatattatttactctatttgaggccactttatgggtgaggtaaaatttcttggtttcttgttatttgatgaggaaagtgttgtcagagtctttctttgtggctcttaggatttgatgattctttaccttaaaaatgcaattaatgatgtcttctaagtagaaaattaaaatcccaagttttaatggagacgagtgtcaagatgcaatacagagaaaaggaacattcttacatgagaatgagtaaggatgagtaacagttttggcagaggaaagcatcgcttacttcctgagtcaacatttctgagtaacttaggtggtaattggtatgctaaatgatttatcttttatttgttttaagtatataatacgagaagactaagtaagacttgagaaaccctatttcaaaatgtcctcattagtggaatattttgcctagagtttttatttactgctcaaataatattggaaataaagcaatgtttaaaaagatcatctgattcccaccatcatgaagtgtcccctccccttttattttttgaattttctaccctttgttggccatattctagtctgctttttctgcagtaataatcataatacaggtacaatgctgttccacccttctcacctaacactgtggttctcaatcctttttttctctttataccactttcctgaaaatcacactccccttggtaacatctttgtgattggcaactggggaaggtatcagaatctggtggggtgaggatttgggtgcattcaggaagatggggaagggaaacgagatctcttgttttgtctgataatagcagacttactgtagcaaatgcttttcatgttaccacaggtttagggtttagctgaatatcatattccattgaaatgatacattatttattgtttagtacataaatgaggtaccattatttatttattatttcttctttcagtgaatcttaaggttgtttctagttttttactattataagtaatgccacgagaatgtttttgtgcatttaataatttataattttcttttttttttttttgagacagtcttgctctgtcgcccaggctggagtgcagtggtgcaatctcagctcactgcaacttctgcctcccaggggttcaagtgatcctcctgcctcagcctccagagtagctgggattacaggcacatgccacaacacctggctaatttttgtgtttttagtagagacggggttttgccatattggccaggctgctctcgaacgcctgacctcaggtgatctgcccgcctaggcctcccaaagggctgagattacaggcatgagccactgtgcccggccagtaatttataattttctaatttgtttccttggggtacatttttctgaatggtgtcatgttaaagggctatgatatgtcatggctcccagtgtgtcatggattatattttcttcacagatcgtgtgcatggtttcttgaaacataaaacataagtcacagcgtatattttcaaggttacctttttagctcattagagttgttccttttgataatatttgaaaagcctcatctgagcttattcaagtgttaatatttcttctgtcactcagttcacccaactcagctgcatagatgagtttcaataaatattccattaacgcttaggcactggaccagaagaggccttttgaagactgtttggaccacagatatgcggggcatggaacaatgaccaaagtacagagatttgtaaatcactatgaatgtgtgcttttgcttttacgacttagatcaaaccaatatcatagaggtttactcagtcaaggagagttaccacaaagcaacagagggcttatggacacaaaacagtggctgaggaagactccaagagcagccattctacagactagagtctctgtgcttggataattatatcagagcaaaggaaccaaaaccccagaccaaagaggaccaagtgaggatgagaaaaagaaatatattccaaaactcaaataaaatacatttctgatgatctttgcttgaatgcaacactgagttatataactaaagcaagtgtgtctgccccgaaataggtgtattattaattcatggatgaaaacaggaaagggctaaaatggcaggtgctctgtgaaatgtgtttgtaaatttaaagctcattttgattagttgtaagaagaagaagaatgagcttactagagagtgaaatacatggtgcaattcttactatctatgcatctatattttttcaggattacagagttagtcacattgacttatttactgaaccagaagggttaggaatcctaagttcctactttgatgatactgaagaaatgcagggatttggtgtaatgcagaagacttgttccatgaaagtacattggggcacgtaagtatttttttttcaaacaaattttaatgaagtttttttgtgagtgtagtactggaaaaagaggacttaagatactctgactctaatttgtcatcctgttaagtaattattaactgtaaggtatatttttataaggcacgtaaaattctgattcttttgcacctatgttatgattcatctgtcttaaaaacagtatcgatttattataggaaatggggggggattgaattttttaatgtaaggctttccttgtcacagagaaatctgatttattcaaagctgagtagcagattatattttcatggtgattcagaggaggtaattcaaagcacatgcccctgatatttctggggggggatggaagccaacacacatggtacttccttgaatattttcacacaatgctggttcaaagcccctaggaggttggtttcacaaatcacaggaaacagcaagaatattttgaaggaaatgggaatacctcagataggggagaaatgaggatagaaagtatagactgcaatactgaagaatgtggtctccaaagtgaagcacaaagccccaaggcatgtgaaagacattcactgagatgcaggaaaaaacactaaagcttctttctatttgattaaagtctccacctcttaagattttatttttgtatatgttttctaatatgcataatgtattagttcagtggtaatgtatataatttataaatattcatatattcagagaatgctcaaatgtttttactaatggtttatacagtcaaaaaagtttacagcctgtccctaaagtggtatggagtatctctgcagtgaacaataaggcactccttaatcatgctttttgcattctatttattactaaaagccttggtttgccattgttcatatcttagaaaaataatttgcttgtgtaaaaggtaggaataggataaattacagatcatagaatctgatttttgatcctcagaaatgagaaactaaaaacttctaggcaacttaacaggaagtgtggctattgagaattggtagcagctatccttgaatagttggaaggtggtcatatagaagagatattagacttgctctctgttattccataggaggtcccaggaaaaaccagtagaaattagagagatggattttgacttgacccagggaagaactttctgatggttaatacagttaaaatggaagtgggctgccttgttaggtaaagagtttctcatcgcagggagtactcaggtagaggatggacaagaatttatccagagctttgtagggaaaggaaagtatgagttaggtacctcctttacgacagtttgttcatttatttatttacttttaacattttgaaatataagacacctagaaaaaagttcacagaaggtaaatgtacacttaaacaaataaagtgagcacccaagtagacaccacttgagccaagaactggaacattaccagcaccccagaagcccgatggtattctttccctatggcagcccgtctcagaaaacaaccttcctctcccagaagagtgagaaaataacaagggaggactatagtgatggttcgtcaatatacaaaggtgtagttactagggcagaatttggggtgtagagaacaatattaatttaaatatctcctcttgatgtataaagttattttccaaggatagtatacattttactgctttttaaattatttttaattgacacataataattgcacatatttatggggtacaatgtgaggttttgatacctgtatacattgcataatgatcaaatcagggaagttagcaaatccatcacctcaaacacgtattatttctttgtggtaagatcattcagaatcctctcttctagctattttgaaatataaaatatattattgttaatcatagttaccctactgtggaatagaacaccagaacttattctattatatatttttaccacattttctttattcattcatctgttgatggacactcaggctgattctgtatcttggctattacaaatagcactgcaagaaacatgcaagtgcgggtatcctttgacatacttgatttcatttcctttggatatatactcagtagtgagattgcaagatcacacaggagttctatttttaattttttgaggagcctctatactgttttccataatggctgtgctaatttatattcccaccaatagtgtggaagagttccctttgctccacatcctcaccaatacttgttatattgtgtctttttgataatagcctttctaactggagtgaggtggtatctcattgtggttttgatttgcatttccctgatcttgagtgatgttgaacattttttcatatacctcttggccatttgtatatcttctttaaataaatgtactgttttttgtgtacattttgagttatatcatttggtaccccgtagtccttgaaaggctctgaaatttttaaaggtggttagtttagaagtagaaattaggaaaggcttttatttcctctgcataccctgtctaaatatgacaagaaattgggactttaacaaatataaacccaaaagagtgtctatgagatgtattaaatatattcagtaaatctgttaatcaagcatctaccatgtgccaggtgcttttctagtcactgggaatacagcagtgaagacataaaatgatgtccccattctcctggagctgtcagtctagcaggaataaacaacacaaatacatatataatgtgtcagatggcaaaggctacaagaaacataaattacagaggggcaggcatgttgctattttagatagggtagctagtaaaggactctggtgacattttaaggagggaccggcaggaagtgagggagtctgccctggagctagctgagggaagaggggcagggagcctgtcccagagaggaagcacaccatttgcaaaagcccttctgggcatgcttgggcaatagctaagaggccaaggcggctgaagctgagtgaagtaggaggatagggataagacagggctcaggtcacatctggcctttcacgccttggggaggaggatttagatttactctacgtggcatggagaatcattggcgaatttttatctaacttgtgttattaatagaaggatcagcctgtctgttcgtatagaaaatagtctgtaaagaggcaaaggtggaagccaagaaaccacgtaggatgcacttgcaatcatacagccaagaagagatggtggcttagacgtgcgatggtggtggtgggaaatggtcagatcttggatgcattttgaaggtagaactaacagcatttctgacagattgtgtgtggggtatgaggggccaagacatgcccagggtttggaaccccaacatttattgagacgaaaaagacttggaggagcaggataggagagagagtgagattcaggagctcagttttggacaggttaaggctgagatgccaactgcaaattcaagtaagtgggcaagaaggtgactatgtgaggctggagttcaggggagaggctggaggcataaatttaggagtcactggcaaagagaatgtatttaaaccaggcacaggacacagtcccaaaggggagtgggtgtagttaagggaagagaaggcacttttgtatttagagactgggaagaaaagtgggaatctaagcaaaagaaaatgccttcatctcttgctgcctttaatttttttacatgaaagaagtctatacacttttttttaaagaattggtgtcaggttgagaaacaccactttccttagaaaagaatgaaaaaggcatctgttatcatattttaatctcagtgtctggaaggtgccatgactcaggcttggctatgttgaagcacattaatctaccttaaatgatatttcttacctttgcagtaagtttagctttgcctcctgggtggtagttaccagcctgtcacagcttacaatttatgacaggtttgtgtcatggtgagcatcttcttttctggctgttcatttctgttgaacactgcctcagatgttaattcaaagtttgggctcgttgaacttggttggtgagcttagacaccaggtcattagtgcttttatagatctcaaaggaaagtctcaaggggttgagaagatgtcactgatagtaagtactgaagctcattttgcttctgttgatgcactggttcccctgaactgggataagaagtctttgctgtagagggaactccttaagaatccattaggtgatttattccagggcccattcactctagattaagctcttctactcatacacaaaataagggtgttacttgtctggtcaaattcttgtttgaggaaatgagtgatttctaactaaacttgcctttcagattctgttgagagtaatttgtttttaaatctttcttttaagcagctggctaatcctggcacccatcctcccagaggtgaaagcatattgggttttttgggggcggggtgtgtgtaggggtggaagtggggggtggtatatttatgacgaacaaaagcaaagaagtttagaacttcaaagggagtataaagatgatctggcccaacaccatcatttgactgaggaagacaagctttggtcactttctccagactagggttagctgttagcagaatgtgtactagaatgcaggtgttctaaagtcaagggacttcttttttaattgacaaacattatttgatcatttgtactgtgtaatatttgacatatacagaataatatatgtatatatgtgaactatgaagcccaataataaaacaatcccccgtggacccaccatccaacttacaacctagaccattaccaacattgctgcccaccgtggttacacatgtaaccacactcctaagattactcatattgatgggtacatctctatgtatttttttcattgctgtgtaatagtcactgtatatttcattgtggaatataccatatcagagcccaattttttattataaaagttttcaaacatacagaaaagtaggaagaatagttcagtgaacaccaatgtaccattcactttgacccaataattgttatcattttaccatatttgtgttatttttctgagcacttcaatgtacattggagatatcatgacccttcattccacataggattcagcctgactctctttctaatggtattcccctgcataagtatcattattacacttgagaaaattcacaaagtgtccatgataatatctgttcaatagtccatcaccaaattttcccaattgcttcaggaatgtctcttatagatttgcattttcaaatcaggatccaatcaaggttcacataaatgcgtttgattgttctgtctcttttaagtctctttttaaagatctctaaaataccccatctttgtttcccaagccactaacttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactaacttttaaaaagatttaggccagctgtcttagagagtgtgccacattctagatttgtctgagtgttccctcatgctactatttagcatgttcttctgttgcccgaatttcctatctactagggcttaggtcttaaggtatggttaggttcaggccaaacagttttggcacggatacttcatatagatagtgccatatatttatgttgtatcacagcaggtggcatgtgctaactagcttgccctttagcaataccaagtttgattgcttggttaaagtggtgcctcctccatctttccattgtaaaggttcattttcccctttgacattcatagccccctctcttgtgaataacctcaaagtcagtaccttcatatttaatttttcaagtatccagttggtttctgtgaatggccaatattcatgtacagccatgtctagggaacacaacttaagatccatctggaagtgctgtttttgtttaagagcaagtgaacaagataagactgatttttcttgtgtgactcaaagggtatttctaaaagagtaattggacaaatattttaaataaacatatagatggccattgttattactttaacaatattcatttgtaggtatacatttgtttgtttaaaaaataagcttgggctttataatcatactgtttgttaagtacgacaataaagttgtactttttaatctatattggcgaaagcttatgacccaagtacatgggaaaataaaagattacctttagaaactgaaataaccctgcctggagatagtttccccctctcctgatggcctcataaataatgtatcttattggaacagaatttagaaaaagtgaatcatactctgcatatgagttttcaaattcaaagtccacccagcattaataaatgtctgtttgaattacccagcaggccttcagcactcatttactaagggagaactttcagaacagcagtcttttcaaatgcattcattcatgttttcggttttttcacaaattcccctctacccagaatgactttccttccatgaatgttatgcaactaaaccacatgcttcaacagaagtgaaatgtttagtattagatgaataaatcccctctgaactcaagctatagaaggaaagacttaatgaaaagggtacttcggtaagaatcatttcaaaatctcagatcgcttgctcgtgagccgtacattcagtttttgaaaaattaaacctgttcacttgtaaagaagtcagacttgggacctgcttggttagcctaataccataatgtgttacagaactgccattattttgttagagaacaaaatccatgggtactgtgcctgtgatagctttgagctccaaaatacatgtaacgtatccttggctgtcatgctttaaacataaggaagtgtaaagtaccctattcttagcgtctgttttcttgtggtttagaagcattacagtagtatttaaaagataagcctctttttttccttaaggtaactttttttgaagcataacatttgtacaaaaaggtacataaaccctaaatatataagctgagtgaattttcacaaagtgaatacacaagcgcagtcaccattcagatcaagaaaaagaacattcccagcatcgcagaaacccgtttctttcatgcgtcctcacgccctcttccccaggaaccatcatcctgacttctaacactgtagttctgacctcctacccatatcccacacctggcctcccaacattctttcatgtgtgtgttgtcaaatcatcagtaggagcctggttgtaaatctctgtataattagagagtctagagaagttaccagtttatccagcggaatcttcacaaaaaccaccgccaaaaatgtgccttgggccaaaattgggaagaagaaaaaagcaaagagggaggggtcagacccgttttgttggtaaaagatttcatttacagccactctcttcttggcatggtgttctggggaacacaacatggtggagtaccacggctaaaacattttagcaaaactaaccgaattgatgagtgtaagtgatcactaagaagtctatgtttgtttatgaagcaggtacattaacccctctcttatagaaaagtcacttcttcagcatcctcaccttctcagaacccttcccaggaacgaagatgtttacaagaagaccttgtaaagtttagagacagggctagtaggcatggttttctggtttcctgatttctggcacattagaggagggtggggctgctggttccccaactgaagcagaagtgacagctgacaagctgatagaagggtgtggtattgaaaagccataacaatcagaaccaagaactcaaaaagctttgtggcctgggaacaagcagccccacagaacttcagagcccctgaggacaccactgtgcattaaataatgctcacagtgatgatcctgagtaactgtgaaaagagtaaactgtgttcaatgcacttcctgcaatgagaaaaattgccatcacaaaaatgattagggctgggcatggtggctcacacctgtaatcccagcacctttgggaggccaaggcgggcggatcacctgaggccaggagtttgagaccagcctggccaatatggtgagaccccctctactaaaaaaaaaatgcaaaacttagtcggatgtggtggtgtgtgcctgtactcccagctacttggaaggctgaggcagtagaatcacttgaaccaggaggcagaggttgcagtgagctgagagcaagccactgtactccagcctgggtgacagaacaagactccgtcaaaaaaaaaaaaaattgattaggaacctggttctggaatcggcttgaatcattccagcctttcatacttatagctgtgtggccttgggcaacttacttaactttatctataaaatggggacaatagcttctcttcctcatagcatggttgtgaggattagatgaagttctcagtggcattccttgtaagctctagggagatgttagctgttactaatgtttggcaccatgacaaatgattagatggaactttggagcaattaataatacaaattaaaataaggggacaaagccagccaaggagaaaagtaaaagatcaagaataggggcatataatggctttatttttccttgagtctagtgtgattctaacacctgagtccaaccattcattatgtaggtccgtatcctctcctgttcttttcctctcatcctgggtaccagacagaaggaaaaactgaaacaaatgatgagtcggctccctttctttccttccatggtggctatttaggtggctgatttatgaagaacctggatttcagggtgttcctttcatcctggaacctggtgaataccctgacttgtccttctgggatacagaagaagcgtacattggatccatgcggcctctgaaaatggtaaaaatgaaatccaaatgtccttgtggtgattctttgtcagcttgacgtggtaattcacagggtgtgactttgaagcaataaagctgacttttaagaaacaaatttgtagtagattggacctattgctcaatagaaatcatggaaagaataacttgctagatgctatagattaaaaaaaaaaaaaaaaaggcaggtaagactatgtcctttgtctttaaggcattctcagccctgcagagctgcagatgggtgcgcaaagcttcagcgcagtgtaggtttaacaagtgaggaaagtgaagaattaaacattggtggaaaaacaggacaaagatacatacaattccaagttgtgggtgatgtgacagaaaagggataattaggaaagcttcatgctaaattaaattcagtcttaaaaaattagcaggatgattttttaaatggagctgtcggtgaatgcactgtgtgagctagggtgcagcctgagagagagcagggcacgctgaggaccggctcggctgccgtgacacgagtgggtggtgtcttgggggtctctggggctggaccagatgagtgttgtcctcctgagtatctgctgtggaagctttgtgcttcctctcccttgtcccagtgtcttgctttgttctttgtttcttccgctagactgtcagctttgggaggaagcaggccgcatctgtcttgtccccagtgttgagcgcagtgtgtgctgcagcatggaagttgttccctaaatacccacagtgagatgaggctcccattacaaacatgtttttgaagctgcacttcgcagttgtcttctgagacagtttgagacaaattagaaagttaggaagacaatttttttaatgttaattttacccatccttccaaagtatttggtttaattatctgtatgtttgctggtcttaatgcaaatgatttgggcttttgtttctaaaattaaactcactttcaaagaacaaagttttgttagttttgtgaatgtatgaaagaattcatccaggttttaggagcagtttgtaatgatgatgaaaagtctccaaagtctatggtgttcaaacaggattacttttgaaaaggtcatgtgcttagttgtataatctctggtttgctgataatatcagccacattcctttttcctttttttttttgcttgttttttcataaaagttaaggaaaccaacacattcttttataattatagttcatttggtgcctttgagcatccttggtggtacttttttttaaaaagctattaaagatatattaattttaaaaaaatccaactttcccattgctgatttaaactcttgaactatttaatatttttgtgcaatatctttttaatgtaataccatttctctgattttagtgagtttttttgtttttaaaaagctttctattttataacaacccctcatagactcatcctttgggatgttttaaattttatttaacagtttatctaattattccatgagtcccccagatcttattatgtgaacttcaacacataatagtttcgtaagccctggttgcaaaatcaaataccttcaggggccaggcagcaaatacaaatggctgagagttaaaccgaagggaatggtagagacggcaaccccgggcctgtgcccagctgaaggatgaactgagggcaggatcgttaaatgcagaagccgaagacagtggcctgggagaatctgggtccagagatgtcagctcttggaactgctttttcaagagaagtatggatttttatgataaattttccaagttaaaaaaacttgctaggtcaaaaaacactcctacaacgcagatcagcttatagactgcttgtgcgaggctccgttctagcctgccttcctcgtgtcttcatctgtattgttggtaattttagaactatctcacgtaagttaaaacaaaccagaacatagtcacactgaaattcaatgttttactgtaaactgctatggctaatataaaatggtaatgtatcagtgaaaaactatttttcttactatgttgtttttttcagggtggccgtaaagttgaattccctacagatccaaaggtaaaaatatatatgtatttttgtatgtatgtatatgtaattatttaaacatatacacatatatatgtacttaatgttattcccactccatctctatgaagatattgcttatgtgacttctcatattaaacctctgtcacacataaatgcagccaaaggaagttgccaacttacacttgccatccttcagggtggaagatgatgctaatggcactggttatcactaagagtacatttagccatggctcagaagggtcattgttatattgagttaacaatttgcagttgtatttactaattgcagggcttcttgctgcttgccaattagccaggaaaaaacttttttaagacaaactttccctactccaaaataccctttctgctattcccaattcccacatcgatgccacacactataacttttcaattttcaattttaacactactttagaatcctctggttccttctatgtggttctaaatatcagttttatatatacatatatatgtgtgtgtgtatatatttattttatatatatatgtatataaattattttaaaactgtttggaaccatggctttgggctataccacattagggaaaaaaaaaagccagatttttttttttctttttactatcttatcagatgccattatttagggttttttttttttttgtggagaccaggccttgctctgtcacccaggctggtatacagtggcaccatcacggctcactgaagcctcgatttctccagctcaagccatcctcttgcctcagcctcctgaatagctgggactataggcatgtaccactacacccaactttttttctttttagcagagatgaggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttattttattttattttattttattttattttattttgagacaagagtttcactctgtcacccaggttggagtgcagtgacgtgatctcagctcacttaaccctctgcctcctgagttcaagcggttctgcctcagcctcctgcgtagctgagattacaggtgtgcatcactatgcccagctaatttttgtatttttagcagagatggggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttatttattttaattaaatttaattttattttattttatttattttattgagacaagagtttcactctgtcacccaggctggagtgcagtgacgtgatctcggctcacttaaccctctgcctcctgagttcaagcggttctgcctcagcctcctgtgtagctgagattacaggtgtgcatcactatgcccagctaatttttgtatttttagcagagacggggtttcaccatattggccaggctggtctcgaactcctgacctcaagtgatccacctacctcagcctcgcaaagtgctgggataacaggcgtgagccaccgcgcccagtcagaaaattttaatttgtgtgtcaggacttagtgatattaaatgactgatttaatgttaagctgttgggatacttcttacagattactggtatatctcatttctattgtaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatgtaagtacatgggtgacttgttaggatttcttttttttccgaaatattaagtaataaatgtgccctttcccccctaaaaacaacattcctgattctatagtatggtgaattttgacagttatatccacattctcctcagcctatagtgactggatttaagaaagcagtttgaggctgggtgtggtggctcacacctgtaatcccaacactttgggaggccaaggcgggcggatcacctgaggtcaggagttcaagaccagcctgaccaacatggggaaaccccatgtctactaaaaaatacaaaattagctgagcgtggtgtcacatgcctgtgatcccagctacttgggaggctgaggcaggagaatcgcttgaactcaggaggcaaaggctgcggtgagccaagatcgcaccattgcactccagcctgggcaacaagagcgaaactctgtcaaggaaggctgatacattggcctgttcaagttgatcaaatctacaaccttgcttattagaattatgctccaagctattgaacagtttgatagttcgctttctgatttttatatttttgcatcttatagatcttgcacatttcccatagaagtgcacactaaagttgctcttgtaaatcgctaactattcataatatttttgttactatctgaagtgagtttatccagttttgcttgctgaggttcttttgagtcagccctgattaaacacacacacatacacaccactcacacacacgctccccttcccttttttatacaactctgatatatgtctcttaggttattttcttggggccattctgttattctcctaaattttaaagaattccaatgataataaagcagaaggtcatgtctagctttataactatttgtatttttcaatgaaattgatatgtaccttgaaaaaatgttaacatgtctggaaatgactactcctcgtgttctttatgttgcagttgggttgcatatgagaaacctggatttaccggtcatcagtatttgctagaagaaggagaatacagggactggaaagcctggggaggttacaatggagagcttcagtctttacgacctatattaggtgtaagtaaaggacaagctaatggctaatacttggtcttctttggataataaatggctagcctttgaattttgaattttttttctcaataggatttttcaaatgctcacatgataatgtacagtgaaaaaaactttggatccaaaggttccagtattgatgtattgggaattgttgctaatttaaaggagactggatatggagtgaagacacagtctattaatgtactgagtggagtgtaagtgaaataatccagttggaattttaaacatgcgttttaccttggtttgttttaaactggtaagagtctatcacagagtaggcattcaatacacaaatatctcaacagcttaacattaaatcagtcatttaatagttgctgtcatgatattttcgttaactctctttaaaaatcgttctcataccatctcttctttttacgtttggggtaggctttgggtatcatgatagaaatctacagatctgtttcccttgtcattctgcacagaaagatagtgaattttttaaatgatggagatcaaataataataatagtaatctaacataaacctgaggctgggtcaaagtcccagtagattttcctgtggtcctacacctgttccagtatatttcttcactattagtttgacataaaaataattgttctatgtacgtggagttagcagttgactgttttattagtggtgaagcaagtttttattgaaagatgtttagtcaagattctttgggatgaagtgactgcaagccaagctaaattggctcaagggattaaaatggaacttactggcttaagtaactaaaaagtcctggagaagattttgcttcaggcatgcctagatgcagcggatcaaacactatcagaacttagtctctgtgtcttgactgggcttttttctgtgttaacttgactttaggtaggccttttgcatttggtggcctgtggccacattcagcttttgttctcctaactctttttttttgaggcagagtttcactctgccacccaggctggagtgcagtggcaaaatctcagctcactgcaacctctgcctcctgggcttaagcgatcctcctgcttcagcctcccaagtagttgggaccacagatgtgtgccaccaggcctggctaatttttgtatttttttttagagacaggtttttgccatgttgcccaggctggtctcaaactcctgagctcaggtgatccacccgccttggcctcccaaagtgctgggattacaggcatgagccaccatgcctggccccagctcatttcttgcagtggaaagagcttctctttctcacaagttccatgtttgactttgctttcctaggcttgggtcatgtgcacatgcctgaaccaatcactgtagccacagagacggccatgtctgggctacgtgtccatctccagagctgagatgtagggtctatcccataggagccacttagatatgaatggggttggtggttccccagggacatcagaaagagtggggagatagatgccagatgggcaaaaacagcagatggctgttatagggagttacataattattcttgtaatccaggctaatgtctattctaatttgttataagtgagagtattctcaaatagttacatgaaataatgtgacattggttatgctgaaagtgtttggtgttaggtttttgttgtcatagtgacatagactatttgaatcatcctagcctcaaccccattgtatctcatggggcctcccacaatagccctggatatttgaaaagtgtgtacaatgtactaaaagttgatgaacatgcttaacttttactcttagtaaatagagtaaaaaaaaccttgttcaacaagttcttgtctaggccgttgcatgtggtgccattttggcagagtatcagtgatttccgggtattccattctcagcaggaaatgcctactcttgggtcctattctggagccctaacattttagaatcagtagcctgtttgcaaaagccagaagtcatctgaaatataaggtacaagttatctgaaatgttgctggggctctgcagtattttagattgtctttaaagctaattatttaggaggaaaacatagtgaccaacttagtctggtgaaacagttgtacattttgatactcaccagttgtgttggttctattagtcagagcctagtcatccaccctggcagaggaagcaaaaggatgctgggtagaatgaattcccttaggtattttgtagatgatgctattaacacaggtagaattattgtgccttgagccaatctcctttcctttttaacccaggccttgcttacttgaaatcagttccctttataaagtgctgctattatatgtttctatttttagtcatttctaattgcatttcctggcttaagcttcttttttctggctgtagcagttaagttttggtagaagggggaagttgaagggagctacgtacacatacgtggacacacacacacacacacacacacaccacttcctttgaaattctttgcatatggaagggcttttgtatttaccagggccaggtgcttcctcatattttgttcgatttgtcatttgacaagtatttattgcggtctgttatgtgcaaagcattgtattatgtcctcaaagaagttacggtatttatgtaaaacataattattgctacaaaagaggtacagattaaatgctctgggaatccacagcagagagagattaatttccagtctggacacagggaaggaagactttgtggaggaggtggcattggagttaggcctgtgggataggataggaaggctgagatgagccaagatgatggaggaggactacctattcactttaaatagtttcaaaggaaaattattgtattttaatggctttatttttattggcaattaagtattttagcttggttctttatttcttattatggcatgcattgtcagaaaaaaactcttctgaagttcttgttccatgaaagtatctcccaggaggctcaccatcacatgggtaatacatcccctgggcagtaaactcatcattagtcctgaaacagagaacagccttcaggaaggatgcccatgaaaccagcaactgaggtttttaggaactgcatttgattcttactggaaatgtcgaaagaaactccctgcttatcagtttctagttctatgctatattcttgctcaaatagtggaaactgggctagttttttaaaactaggagcaaaatgaaatatttctggtattcagatgaaaacgaaaagtgttgttgttttaaattctttttcctttggccttccacggaagggcaggtttaccctgctgcccttatcttctgagcaattattccaccaggctgggacctgctagtacttgtgtacatgcctttcccccgtctccccaccagtctttaaacagaggagtgttgattcatgtgtacagaatacatctggacaaggacagggagggattttcttaagagccccaagtgtaagttgtaagtagactctcggatcatagagcagagaatctcagatctgggttttgcggcttctcccctcccccactccccccattcatgggtgattcatcaggtatcttggagggaaaacaacactactgtcagttcaagtaacatcttaataaattgttttccagcttcagcttcagtgaattagagataggcttagctgggtgttgggtatttacttacaagtagtttagtttcataggaaaatacagtacccatacttgttagtaaaaagaacagagtactggctaaagctgcttccagggctgtcctctctccttggcattcagcctcccacctcactgtcttttttccctccaaaccttgaagtcaaacagaaaggcctttaaccctcttatctctctacttgttacagactcggagccctggtgagaaccctttttttgatgtggctctacttctttaattgttcgttgtttttttaaagtcctagtgtttgtaacgtagattttctttttttttaaattttattattattatactttaagttttagggtacatgtgcacaacgtgcaggttagttacatatgtatacatgtgccatgttggtgtgctgcacccattaactcgtcatctagcattaggtatatctcctaatgctatccctcccccctccccccaccccacaacagtccccggtgtgtgatgttccccttcctgtgtccatgtgttctcattgttcaattcccacctatgagtgagaacatgcggtgtttggttttttgtccttgcgatcgtttgctgagaatgatggtttccagtttcatccatgtccctacaaaggacatgaactcatcattttttatggctgcatagtattccatggtgtatatgtgccacattttcttaatccagtcatgtagattttcttgatgtgcagacactcctcccacatagcagtgctccctgctctggctttactgttgcttcctttcatgctgggggtaaagcctgaggccctgtgggcagaggcagcacatgcgggtacccgtgtgctgtacagcatcacctggtcagcccggggaccttggcccactctcctacttacacttgaaaatacaaactttcacaaaggttaagtgagttcttcaaagttatctgaaagttaatgtcatggccacaggtggagccaggtctcctatctcctcacctctcagtgataaaggataggtttttaggccgggaacagtgctcacgcctgtaatcctagcactttaggaggctgaggtgggtggatcacttgaagtcaggagtttgagaccagcctggccaacatggtaaaatcctgactctactaaaaaaaataaaaaataaataaaaataaaaaagaacaggttttaaaaattgctagtgaggttctgaaatcgggggatggggggtggtagggggctgtatttcctgaaagactgagtggtgcatatagcagcttctccatttggatggctgggagtgagtgcacagatgttggctgttattagctacttctcactggagattttggcagtgttctttttttccttgatggctgttcatattctagtaattactgtacttgagtttttgtttaaatcagccctttggatagtaaaatcataatctgctctaattataaagtgtgtggactgttttaggcatggtttactagaacagtaaatgaaagggaactttccagggcacatggcaggttgggtcacaaagcaaggagagcctggtgggcctcaggacaggtaggttcagtcacgttctggccaatagtcgattgtgtcaccctggacaagtcatttcccattcaaaacaaataccaacaaatacttccatgtgatgctgcttacccatctgtgggctttggaggacagagattttgtctttttcatctttgtatatctagtgccagtctagttcctggcacctggtaaatgaattaacttactgtgtcttaggtttttcccatctgtaaaatgggaacaccaatacctccctaggagattaaatgtgataacagatgtggaaacattttgcaaagttctgatcaccctacataatacatacatagatattattcctttaagctttgagaggatcatgagaatgatgaattaattgaaaagatacttaatgtcttcaatataatggtattaagtatctctttaatataacagaactgaaaaaccttttcctttcaaagactttatctttgcataggaaatagcatcattaaattggttttgttgattttcctctgggtgtagatcacttaaaagagaaaaaaacattccaaaagagatttatttttagtatttctatgagtttgctcaattttgtttatttaatttttacatatttatgtgatgttggaaacactgttggaaacaatattttagttctgttctgcatttttaaaagcatttcttctgttaacttctttttcagtgtggtttgttgtgtaatagacacagcttcctaagatctttctgcaaaaatattttaaggttgagaatgaaaggacttattgattgcttattaaaagaactaggttcttcttgaaagtcctgtttgttttgtttccttagaatacaattagaaaaaaaaaagcacagagaagtattgcctttgtagctttctcaagaaatagtatttgataagcgagaacgccaaaaagttcatgtcaagatacccttacgcttaccatttcttttgcattaagttttttttcaactcttattttagattcagggggtacatgtgcaggtttgttacatgggtatattgcatgatttcctgaagtttggggtacggttgaacccgtcaacctgagcatagcatgcaacaggtagtttttcaaacccccctccctcctggccccttttgtagtccccagggcctatttttttttcttctttatgtccatgcatgaccaatgtttagctcccacttatgggcaagaacatgctcataagtatatgttcttgctcataaatatttggtatttgattttctgtttgtgttaattcgcttaggatagtgacctccagttgcatccaagttgctgcaaaggacttgatttcattcttttttatggctgtatagtattccatggtttatatgtaccacattttctctatccaatccaccattgatcaatgaacacctaggttgattccacatcttgatattgtgaatagtgtggcagtaaacaagacacgtgcaagtatctttttggtagaataattcgttttcccctgggtatatcccagtaatgggattgctgggttgaatactagttctatctttagttctttgagaaatcttcaaactgctttccacagcagctaaactaatttacattcccaccagcagtgtataaatgttccctcttctctgctggcttaccattctgatttgtcctatagacaaacccatctgcttctaaaggttaatggagaatcagaaaaattaaaatttcaattggcaaaacaaatgaaagtttctgtatgatacatagatatccaaatatgtgatcgttttatatgtaaaatatgaactccaacaagtgattgcttttgtttcttagatgggtagcctatgaaaatcctgacttcacaggagaacagtatatactggataaaggattttataccagttttgaggactggggaggcaaaaattgtaagatctcttctgttcaacctatatgtttggtaaggagttatatttttgtatgagaatatttaactgaattctggatttccttaatgtgtgttcctggttcatgtaatagtaattgctatggaaaatattctgagtttatttttagcagtaattgctaataatctagaagaaaaaaactttttcaatgtgtttgttctattcatttccttttctccttcctttaaaaatttttaggattctttcactggcccaaggagacgaaatcaggtaactttaaaaatattcttttatattaatatataaagggccttccattgaaaagctgaacttatgtttcaaatgtcagacatttggggccgggtgtggtggctcacgcctgtaatcccagcactttgggaggtcaaggcaggtggatcacttgagctcaggagttcaagaccagcctgaccaacatggggaaaccccgtctttactaaaaagacaaaaattagctgggtgtggtggcttgtgtctataagctcagctactcaggaagctgaggcaggagaattgcttgaaccccaagaggcagatgttggagtgagccgagatcgcaccactgcactccagcctgagtgacagagactctgtctcaaaaaaaaaaaaaaaaaaaaaaaaaaaaaaatcagacatttgggacattttgttagttttactcatttttatgcctgaaagcataattgtatttaaaaaataagatttaagtttactttaatggttaattgacagtactgacccatgtctaaataattcttataaaatgcttattgtataaagctgaattttatatcattacattgactcagtttatattaatacattgagattaatatttcaaacaatagcatctagttattgtgatggtaaaatgaattttcatatttgctgtgtcgacactagacattttttatggtctcactcaagctttctgaatgctgattcttaacatcaactggggtgtacatttgttatttcggccttttaatggaagtgttcacagagccataattatagaggaacaaacaccactatagcctcctttattggcattcacaggattccgataagtcagcaagtgtcttccattgagaaggaaggaaactacactatgtctttccaaaatactgtttgtcgttaatgtcagaactgatgaacaatgatttctgaccacaataaagctttaaaatacctcacagcttcacaacagggtgttctatagaaagttacctttgttgttgcattttactttgatgtctctgaattaaataaatagtcacgaatggcgcagctaacatgtttctaattgatcatgaatgtagacatggaaaattaaaggatttctaaaattcgtaccagtttactgtaacaaaagtcagcaggtcatgtttaggtcatcatttcaaaggctaaattagttaatgtgtttaggaaaataattttatgtgtttctgtttactttttcaaagattcacttgttttcagaaccacagtttcaaggtcacagtcaaagttttgaagaaacaacaagtcaaattgatgattcattttctaccaagtcttgcagagtttcaggaggcaggtaagtgaaacaaaggcctggcagagctgaatcactggagtaaaacagaattcacacatcagcaagtatatagtgatgcctgttaggtgcttggcactatgcgaaaccaccatcttagtccaatggcgtgcttcgtgatatctgagtaccagacgccagaggacacgggcttcaggttggttggagaagctgaagatcatctcattgtgtaatggaattcagagcaggttctttactctgtatgtcttcccatcatctagaaagggagagttgggctctagttaatccaaggtacctcccaaggtggattgttcaaaggacaggatcggcactctgcattaacaggaaggtagaaagtacacgctggagtggagctggtggacacgcgaatcagggagcataccagtccggcttgctgggagggctttgtactgggaggagaagcaaagctgagcacactgagtttagatggcttccacaggaaacacaagacccagggcaaaggcaatgggctcaattgtttcatgctgaaacaatccttgtacaaaagcttcatggagaggggagagcccaaggtcagggaaactcggtcaggaaagccttggagcaatctgtgcaagaggtgttgaggatttaagtctcttaataatagtagtaatagtgcctttaatcacgtggttctttatggttgaaataatgctatcctgtcctttagtattgcacagcaaaaaagcactgactttgcattcaaatacacagatggaggccgggtgcagtggctcctgcctgtaatcccaacacttagggaagccaaggcaggcagatcacttgaggtcaggagatcgagaccagcctggccatcatggcaaaaccctgtctttactaaaaatacaaaaattagccgggcatggtgacacacctgtaatcccagctacttgggaggctgaggcaggagaattgcgtgaacccaggaggcagaggttgcagtaagttgagatcatagcactgcactctagcctgggcaacagagcaagactgtctcaggaaaaaacaaaaaaggcaaatacatagttggatagtaaagcttcctagtttgttggacatactgctaccacatccccactcctcgttatcccctgcctgcttcatttattacctccagtcctgtgcatgtttaaaattacctgtctcagctcactagagtattaacttcaggagagcagggactttggttctctgctgtatccccagcaatagaaaagtacctgacacataatcctcaaaaggcatttgttgggttaaaaacaacaacaacagggccaggcacggtgactcacacctgtaatcccagcactttgggaggccgaggtgggcagatcaccaggtcaggatttcgagaccagtctggccaatatggtgaaaccccgtctctactaaaaatacaaaaattagccaggtgtggtggcatgcacctgtagtcccagctactcaggaggatgaggcagaagaattgcttgaacccaggaggcagaggttgcagtgagccgagatcatgccactgcactccagcctgtgtgacagagcgagattctgtccccccgccaccaaaagaaaagaaaaaaaggaaaaaaaaaaaaaaggcccacaaacttctaggggagcatggcaaatcaccattttatgaataatgttgataccagagaggctaagtgacttgtctaagtcaatatagtattttgactcctggcccagtgcagaggtattagaaatgaggatagaggagtgtgcgagaaattttggaaggaaatcaatagaccaaatcaataggccttggtgattaactagtcacaaagcttgaagaaggattattcaaaaaggacttgagggcttgaagctccactggctgggcaaacggtggcacccatgagaagagcaaggaaggctggaggctggggaagtcagaaagaacgtggagaaagaagtttgtttcccaaatgcaaagttaactgacttattatgaatattattttgccacaagcagaaatgcaataaatatatccaaatatttttgaagaaagaactctgtttgccagaagcattgtgtttattttatagcaggccacctctaaaaatcagacttcttgaataggagtgctcaagttgcatattctgtgcatgtgtgtggtttttcccattgtagctgggttgtatatgatggagaaaatttcactggtaatcaatacgtgttggaagaaggccattatccttgtctgtctgcaatgggatgcccgcctggagcaactttcaagtctcttcgttttatagatgttgtaagtatgtcattgtgaatagtgttgcagaaatgtatgcctcatatagctgatggtcagagtgaggtaaccagccggtagaacctgctcttaaagttagttaagggcttggagatggaactgtccatttggctctgtgtacatctagtttattgattctaactggtacacgttttccaccaccctgttttactcacttaatcctcatatgcatatccctatggacctgagtgggagtctcttggactatatattaggagtagaattactggatttcacatgtaagaacaggcagtttcattcagtactgccagatcccaccacttgagactcccaccagcagtacacattgttgccattactgaatattctctcattctaatttttgtcaacttgatagaatgagcagaaagcagtatgtcgtcattgggttaatttgtatttcactattagtgaggctggtatctcttatttataatttgcattttctattcaaggaattgtgtattgtatcctttgcaatttggcttcctctacctttggttgttattattgaagaaattccttataggtttttagtctattattattctgtgttttagagatttgcaatcaaatgacttctcccagtttgccactatgtgctaatccagattatagtgccctcttttggacagaagtctttcagtttgatgtagtggaagtaatattcaatagaacaaaactgcaagatcatgttgagatattaaagtctggaagtatctgtcgtttctgacatttttattagtttttggtaactgctttctcataaaaagctttaaacacacgtaattgctcattttagttttaaatgtaggaagaacgtatgtgagttggttttcatctcatccctgcctgcctgtttaaatagcaaaaatgctactgagacatgaaaatagtaacaaagaaacatgaaatgaggtagtaagattcattagcttacaagtaatgaataagactttgattgttattctgcctagaattctaaaagctacctacaagtatatatttgaaaatttcaatgccttccctcaaccagaacttggcatatatgctcacaacactctgaggctatagatgacatctttttatgttttaattgtgaggaaatgaatgttttacccatatgaagactacatatctttgtgacttaatacttcaaaattatttaattgctttttaatactaaagtgtttagaacatttttgggcttgccatctcaaaagtgcaataaaagtgcaaagtagtaatactactataatttttgtcttctttcctccatgtatgttttatataaactaattcctagaccacacaaactacttctacacactaacatgctctgtttactgatggacaaaatctttttaccagtcaggacacatccacataaatgaagcagtaaggtaccgcaccctttccacaaactttaagcaggatagggaaaaaattgtaatccccacatgcttttattttttttttttttgaaatggagtctcactcagttgcccaggctggagtgcagtggcatgatcttgactcactgcaacctccgcctcccaggttcaagtgattctctagtctcccactcagcctccaaagtagctgggattacaagcatgcaccaccatgcccggctaatttttttgtgtttgtttgtttgtttttgtatttttaatagagatggggtttcaccctgttggccaggctgatctcaaactcctgacctcaagtgatccgtccacctcggcctcccaaagtgctgggatgacaggcgtaagccaccatgcccggcctcccacatgctttttaatgcatcatttatgatcttagcagtactatcattagagattaatgtagaatcaaaagtgtctataatttgaaaaaacaggcataagctgccaacttttcattttcctgaacagtgaacgtttgtgctgttgtcctctttaaaatgattgacagtttgaacatagagcttccatcctgttgttttttttctctcctcttgacaatgattcctacaggaaagtttgggagcatgagtacacagaatcattgtcttagtgatgaacagaaaaaaaaaagacatttgaaaatacatacaagaggaaggttccctgattaggcaataccactgtacactaagtgactaaacatcagatgccacagccctctgacccttggcaattatgtccatgactttccagcccctccttgtcccagtgaaaatggctaagtcaaaaataaatgccatcagaagtgttgatattcccagcgtatacccatttctcttttttttttccccctgttttacaaactatttatatttacctgccttcctatgcaatggagaaactaactgcccctctgtgctttctctctagcttggagtacacaaacatccaggctcccttggaaaaggagtttatggaaaggccaaatctagcagattttttgtgctttgtccttgtaacaagatgattttcacataagtttgaattattaacaaagatgaataacagaacattgtttttgttcctcaacaggaattttctgaaccaacaattattctctttgaaagagaagacttcaaaggaaaaaagattgaacttaatgcagaaactgtcaatctccgatccctgggattcaacacacaaatacgctctgttcaggttattggtggcatgtgagttacctacttgttgactcaataaaatagatcattttaaaaatcaagtttgggctgggcacagtggctcacgcctgtattcccaacactttaggaggccgaggtagaaggatcatttgaatccagggattcaagaaaagcctgggcaacaaagtgagaccccatctctaccaaaaatttaaaaattagccaggtgtcgtggcacatgcctgtggccccagctacgtaggaggctgaggccgaaggatcacttgagcacagtaggttgaggctgcagtgagccgtgttcacgccactgtactccagtctgagtgacaaagcaagaccctatcttaatttaaaaaaaaaaaattgatcagatttctccctctcttatattatcttaaactaattgacatataccctctctttttgtaagggttaataattatgcacctttgtagaacacttttccactgggaaaagtcatatgtaaagcatcttttatttcattatccagatttttagtttatttaaggtaaggattttgtctttaacacctctcatagtctagcaagtaagaaagagctgactttacttatccctttaaaaaagagcaagtcctctgattttggagctcagggttgggattttcctttagctgggaatgactggcagatgttatacaaatgattaaaggtcaacttggaaagatttttttcccctcaacttcgaatacttttgaataagatataaaaatgaatgagtaccatcaatgtaatacatgtttttaagaaagtatttttcttttattcacaaaaacaataggtatggtctacctgtgtacaacagatgttggggtggactacatctatttaaaaaataatcaggccgggctgggtgcagtggctcctgcctgtaatcccagcactttgggagggcaaagcgggtggatcacctgaggtcaggagttcaggaccagcctggccaacgtggtgaaaccctgtctctactaaaaaatacaaaaattagccaggtgtggtggtggggcccctgtaatcccagctactcaggaggctgaggcaggagaatcacttgaacccaggaggtggaggttgcagtgagctgagatcacaccagtgcactccagcctgggtgacaagagtgaaactccatctaaaaaagaaaataaaaaaaatcacagaagctgggcgcagtgactcacgtctgtaaccctagcactttgggaggtcaaagtgggcagatcactggaacccagcagttccagacaagcctgggcaacatgttgaaaccctgtctctattgaaaacacaaaaattagtcgggtgtggtggtgcacgcctgtagtcccagctactcaggaggctgaggtgggagatcacttgagtctgggaggttgaggctgcagtgagctgtgatcgtgccactgcccttcagcctgggcaacagagtgagacctacctggaaaaaaaaattatagaatattagggtggtagaattatgggtgatttttttgcagtaggttttaatattttgtttttatgataagatgactaaaatgataaaattttatccaggatttaagttccaggattaaaagtagagtgcattcttccctgatgtaatatgcaagagaggagggcgctgggctgcttccacgccagtctgcgcttaaacccatacttcctcaggtgtgcagcagtagcatctgagcggaagggaactgagtatcttagcagttttttagatttaacaaagattactctcactgcagacaaaactttttatttaaccctatttagcacctactaagagctttggaaatattaacaacttaaagacccattattacaactgaagctattttatgaatagttcccaggaagaactgaggaatccactaaaagacaatatttcactgctttacggaggaaaaaacttacctatttctcttcaagaatggaactttttggcataagtactcatgtaacaaaaatttgctatttgtcaagaaattacttcttttaagtgttctagaaaagatcatttttcccccaatgtatgttaaaagtatatagttcagtctagaaatggaaagcattctaaaaataaatgtaattggggtccactgtcaaatgaaaattgccacttactgtggttatttttgttttcagatgggttacttatgaatatggcagttacagagggcgacagttcctattgtcacctgcagaagtacctaattggtatgaattcagtggctgtcgccaaataggttctctacgaccttttgttcaggtattttcttcctctccatgctctgcatagactcttctctgaaatttttttgtaaatgcaatccaactttttatccaatttttttattcaaagtttataactggcctcaccctataaactccttccctgccccaataatctgggctcagtttctggtgctaagaggtgtggctgcttcagaaggccatcaaactgaacatcaaacgcagttatccacaggcaggcaccctgcctcaggcgctttgacattttgtcaaactcttctcattgagaaaatttaaaacctctgagactcttgagtatggtaattacccttaatccatatctcactttggattcttcctgatattcatgcttgttcagtgcttccagcagcacatctggtataacaactgctgggggttttgtcttctagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcagggtgagctttaggattccacgggggcctgtgatggctttgctaggaggtgactcatcctttcatatgcttttgatcttttcttcaagtagatgcaatttcacaattcctggagtactttcagaaatgaatttgtttttttcatgacagtatatcctagctctgatagaaccagtctaggaacttaaaatgaaaggtaaatatagcactgatccaagatagaatatttatttctatgcttgatttttatatagtagtagaaaaaggaagtgtgttattcttccctttttccttaatgtaactgttacagaaacaaactataagctccagccctgtcaacaaaaatcactcttggtttgttttggggaaatccacagaacgggatgaagggtaaagagatccctctgtgtgctgcacagtccatttcctaagtgtcatacgttgtaaattagaaaatggcccatgtccctcctgcatcattcctactattaacagacacttaaaagctgactgtagtaagatttttatgaaagaagctcatgcttctatggtagataaaacttttttactccttgattttgtgagcttgaccgttggctcctgattttctttaaaaaaacaaaacaaaacaaaacaaaaaaccaaaaaaaacctggtgccccgtgagtcagcagaaggaacacagccttgcgaaaaggagtacaactcgttaattgggtctgttgtgctggagggggaattctttcagtaaacagaagtactgtttggacatgcatagaagaactagcaggaggaacagaagtagttgtaatatggaatcatgaaaagaagctttctgcctttgaattgtcttaatccaagaaaatggtgtctttcagcagttatttctaacagacatttcagtgatgttatttaacaactttgaattcaataggtcaatgagaaaaagtctcctagattatcacagtgctttcatctcaatatagaataatatactttaattttttttagacggggtcttgctctgtcaccaggctggagtgcagtggcactatctcggctcacttcaacctgtacctcccgggttcacgcgattctcctgcctcagcctctcgagtagctgggactacaggcgtgtgccaccacgcccagctaacttttttgtatttttagtagagacggggtttcaccatgttggccaggatggtcttgatctcctgacctcgtgatccacctgccttggcctcccaaagtgctgggattacaggcataagccactgcgcctggcctacaataatacacttttaacaggcatttttatagcaacattgttttgtttttgtgtttgagacagagtctagctctgttgcccaggctggagtgtagtggtgcaatcacagctcactgtagcttcgacctcctgggctcaagggatcctcccacctcagcctcctgagtagctggggcccacaagtgcatgccactatacctggctaatttttaaaacttttctgtagagatagggtctcacaagtgatcctctcaccttggcctcccaaagagttgggattacagttgtgagccactgtacctggccagtaatttttgttaatggcatgtgaacatgactgccatacattatttatatattaagggtagattcacttcagggaagggctcataaaatctttgcattaaaacaccctctagtgagtctgcatttttctgttttcatagctggaaagcatgcctgtttagaaaattttaattctcatgaaggaaagacaaatgctaataaatgcaattccgagttttaaaatgataaaatgccctttagccacccagtgctacaaaattagaggtgcagtcatatactggaaggtcaggccaagcagaggtggagatgtcagagggagatatagctacagaacctgcctgggatcatggtcacttatgacagggaaaaatatgatgggcagttctaatgttatgaggctttccctactagtaagatagtcttgcaaagggcagaagtctctgacgatgcacaaacattgagattttcccatcattcgtgtcatctgaaataaatggcataaatatttattgtccgattctagttggctaagagctgaactgcctcatgtggggtaaatgaagctaggaactaagataattttaaagcccaatgtaaccagagaaataattgctatgagacttacagctggatacatatttaagatatctggtcttttccactgagcagatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaaggtaagggtcacttcctttattttctttattgtaatgtgtatgtcttttagttaaggaaaaatctattcataacttttgaaaatgatgaatgtattattagtagtaacagtaagagagcccctactgtgtgccagctgctgtgctagccactttcagtacaccatgtcccgtcatcttcacagccgccctatgaggcctacattatcccctctccctcttttctccccagttttacagacaaaacaacaacaacaacaacaacaaaaccccggaagctcaaaggggttggccagtttggccacaatctcacagctgtaactgctgaaccagaatctggccataggctgacttcaaacatttattttattataatagtgttaggctaaaaatcacaagctgaaaggccgtgattgcacttagttcggtagagttgatgattctcatgtatacacgtgacctttcattgaaaagatctaagatctcaaaggaattaacacagcctacaggatttcaatgcaacatgtgttcaatgaagctaatagggagtgaactgatggtgcttgggggagaataaatttagcgtggttgtcctcaaactttatttgcatcagaatcacctggagggcgggttaaaatagactgtggggccacatcctcagagactgagtctgtaggtctggggtggggcctgataattccttttctaacaagttcccaggtgttgccaatgctgctggtctgaggcccacacccggagaaccactgatagtcatttaaaaataacataagaatgacctaacctctgtgtgggaactcagtgaactagtgtgttgctattgacaggtgcagatggtgtgttcatgtcatctggggtaattctgctttaaattaatgggcacttttttattccctatcaggaaagtcagcacaattgtgttttgtagcgaactggtgataatgtaaccatactacatactccattaatttttttaaatttttatgagtatattacatactctattttaaatcatcactacaaaatgactcaattttactttaatcagggatttaggccaatgctgtcattaaagtttatgatgtaggggtaaagagccaggtgccgtggctcacgcctgtaatcccagcactttgggaggccctggtgggtggatcacgaggtcaggagatcgagaccatcctggctaacatggtgaaaccccgtctctactaaaaaatacaaaaaaattagctgggtgtggtggtgggcgcctgtagtcccagctatttgggaggctgaggcaggagaatcgcgtcaacccgggaggcggacgttgcactgagccgagattgtgccactgcactccagcctaggcgacagggcaagacttcgtctcaaaaaaaaaaaagttgtagggacaagaaagtgctgtaatctgatttttaaaaaacaacttttctggataatggagaacgaatctggacattttcatcaggggctttggtaactgtatggggagcaaaagtggctgtcacttctgaatgatctccaggtaggtagcttggccaacccacttaaaacaatggacttaggatcagacagaatctgagaagttggaaagatgctcagaagcaaacaatgcctttgccttcattaaagggggcacttagggaacacaaactaagcactgcaactacaggctggatggagaccacaaagatcatataaaatgcaagtagtacccttggatataagaaaataaatgcaatattcagaaaccaaacagtaacatatagtacagctccctcaccttacatttggtacaacagatttgtcaatatgtagacaggtgaaatactcattttatagatgatcaacctgaggttcaaactagttaagaattatgcagatctttgtttattcttattttgataaactttattgcactagagtgcttcagtgttgacaagagtttcaaaatctccagagacaccaaagaaatgtgactcaattggaaaaaatggagtttttgacacaatgttagagaaagtagggtatgtagttctcaaaggaaatctgaccaaaccttcctgttttttacaaatgtgatctgcttcctatgtccagggtggacaacactatgatccttagctagagctttcttctcttattctttcaacatgtattcacggggtacacactatgtgccaggctcggtgctagacacggagggcaccagcgtgaaaaaaaaaaaaaaaagcctcctccttggcttcagacagtttacgttctagatgcgctaggcacacaggatgtccctgacttgttacattagcagcggaccagaaggaaggacacctcactccttgtcttggctctgacatgaaccgtgggactctaggtttcttaagacttctttttaaagctccagagccccttcctaaatgacactatataaattactcaagtgcctgctgagtaagcataatgtcccgtatatttgtgaaatctcagtatctagcacggtagcaacaacagtctttttttttttttttttttttttttgagacggagtctcactctgtcgtccaggctggagtgcaatgacacgatctcggctcactgcaacctccgcctcctgggttcaagcaattctcctgccttagcctcctgagtagctgggattacaggtgcctgccaccacgcccggctagctacaacagttttaattccttgttaaactgaatttaattttctcagactgggagaatggtgccatcttgtggacatgagagagcagcgccgcacgtcccacaccccatgcaaaggaaaatataaacacgtctcttctcgttggtgcacttactagcagaccatgatttccattagctacaactactgaaccatttgttatctattaaaattgccctaagaattattagatcatgcatctgtcttctagctcatcttcttgtgtttgggaaatgagttcttttggtagacattcatgtattattccagaccacataccttgtaacaacagtggaagctgattcatgttcactttaaaaaacatgaagtctgcacaatttaaacactctccaaaggcaagagaatgaatcaaattatttctcaagaactttctagttttcatgattctagttgaatttatatgaaagtattttaagatactttacttttaaaatacaaaagatactcttaaaatacaaaaagtattttaacatactataatgaagaatgaaaagagacattgtgactttaatacttcctgaaatttcagtggagtatgctgtgtgtctctgtctcggcagagtgtagggtttgctggtagttttttccctactgctacaaacttacacataaaggcccaaaacaccttacccttgtattctatagtacatctagccatacatctagctgtgtagaggctgtagattaccaatgatgataaatcagtgtctcacaagagaagagacgatttccttcctcaactataatacctagatttattgtgtaaattcccaaacctttttcatattttgtaaatgcttcaaaggtgaaaagaatgtttatttcttcttgatccaaggaggaagcatgctttcaataccagtcactccctgcatcaaaatgcacagatttttactttgatggggtctttgttgatacatccttggtgctgaggtttatgctaaaaaaaggataagccatctgaagggatctttattctacactggaaaaaaaaaaatcagataacccttttgttaatgatacttctccaaagaaagaagccatgaggctgtttttagcactaaagtatctgaaacatccagtaagcacctttggaaaatcttacaaacattctggtaacagggagagagttcatgataatagttttacaatactgtggtactcagcatcctaaatgctatgaaattttatccaccaactgagtccccagtagtgacaatgctaccgcgtccccttatgtacttccgggtgtcatccaaacctcccctttgacctaatacagcccgttttcattgttcatgcaagtgctgttcctcgataaccattcctcccacctttccaccactgccaggactacctgctctttcctcgctggtgtctcgaatctaccatctcaccaccaaatatatgttagtctctttactccttttcccttctctcgggttttcccagttcccttgaatttcagacattgtaagagtgactgtggactagctcttaagaactgggtagaaaaaggagcccgtgaggtgggatgtcctgtgtgaaggtgctggtgccccaatggtgggatctggacagattcacccatggcaggttgaccctctcatcccacaggggcccaggcttccctccctgccttgcctccttgaggcatgcagttctacaccttgtttacttgcttacttttgctgtactggtgttaggggaattgtgtctgctatagacccttcaccatgggtacattcatcttttattattttcctttcttttagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgatgaa

SEQ ID NO: 1354 - DNA, 66150 bp, Homo sapiens
tgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggtgagcgcccggccccaggcgcggactgctaggcacgcgctggaacgcggacccggcgggcgcgggggcggggactcggggcggggcgccctgctcggccccctccgggcctcgttgctaccccgagccttcgcgcggccccacggccccgatccctaggcgtggctgggggccccggaggaacctgcccgagccgtacctggcgctgctactgcccggcttgggtgaccttggggcagtcccttcgccccgggcacctcagctccgtccttgcaacaggggggagctcctgggggaaaccccgagggcggggcggggtgctgagcgcgggtcccggcgcatcgcttctgcctagaaaactctcattgtcatcagattgacctcaccgcgggggccggctttcgctttctttagtggcttggtgtgaaggccgagccagtggtttgggcaatttccctcccatcaggacggaggctcttggtgtgtgggttggaggagtggggctgggcccaaggagacgattatagttgatcgggaggggccagggtccttgctgagaggacccagccgatactcgggcctctgtgttatggctgagggacgtaagacaccaaggaggaagtgactgccaagatctcagctggatggaagcatagttgggaccgggaccagctgtggggctcccacgtagctttgttcccagctctctttctgcctctattgatgagttatgtgttgactgggagcatctagctccaagtctcaccctccatctcctcgtggggttctttgtggtggaaaggagagaaggaagaggagagagaacttgggcatcatggggacatctagattgggtcctcagatcctggcgtctcatctgatctgatgtctcagtctcctgggtgtctccggacacccacaggccagatttctctgagtgtgggccaggtccacaagtgggggaggactgctagacatgccagggcctgcctgggaccccttggggcctgggaacctgcattttcaacccattccccatgtgagttttacgtccactcaggtttgaaaaactgctctgcccaggttttgtaaggtgtgactaggtgagggcctggggccactgggatgaagtgaggggaaccagcacagtttgggggcactctgaaggggatggactcagagctaggcagaacgcactgttgcctgcctgctggggagagcacagctgtatcccaggcccagcagcgggtcagcctggcctttgggtggttccaccctggggtttccctagaggttccgagggctgatggccctacatcagatggagcagtttgctgttgtcctctttcatctctgatattcttccagcctgcctctggctgagtgaccttggtcgaggttgcttaaccccctgggtcccagtttcctcatctgtaaaacgggctgatgcttatacagccctcagaaccacacctggctcagaagtccccaaatggtagctgctacaattgctcataaaggaagataagtgactagctaatgaccataatcatagtaagcagtggcatgacacagatatcaaaaagttgagtggcacttcctgtcacctgggacctgagctcacttgatgtccgttcttcacttgggctgaacagaataacatacatgtcatttacagcccgcttcgggatcccactgtggctgaaatgtcattgctaatcactcgtggccctccctcccactgagcatccatcgcagaacactcgcgtcagccactattggttggcactggcacccaggtgcaacccatcagctagctgcctgggtcatgttgccagtgccagcagtgttctgcgcccatccagtccacaggtcctctccagctgtgctttttccctttctcttctccatccttccctggggccttgcagatacttgttcttctctttgttcatctcttctggtccttgcctttgtgccgcactggtttcctagactccccgcctctcctgtctccttaatgagaactccgtcaggtcaagggtgggaggcaggccgggcctcagcagcattttggtgtgtttccccaagggcagaccggggaccgtggagacatttgagatgattttaggggttgcccccatggaccattcaatcacccgatgagaaagctttcttttcacatctctgtcaattttgttgattatgtcaaggagaaagagtcactgggtggtaatatatgcatttttaacacctaacactgtccatttttcttaagggaactttcagcatgttctgcagcagcgctcagcttgaatttaatatttgctttgttttcactatatctgttttactcttcatagctttattgagatgtagttcatgtaccacacaactcatccattgtaaacatgatttgatgatttttagttaaattatagaattgtgcagtcgtctggccaggcgcggtggctcacgcctataatcccatcactttgggaggccaaggcgggcggatcacaaggtcaggagatggagaccatcctggctaacacggggaaaccccgtctctactaaaaatacaaaaaaatttagccgggcgtgatggcaggcgtctatagtcccagctacgcgggaggctgaggcaggctgaattgcttgaagctgagaggtggaggctgcagtgagccgagattgcgccactgcactccagcctgggtgacagagcgagactccgtctcaaaaaaaaaggctgggcgcggtggttcacgcctgtaatcccagcactttgggaggctgaggcaggtggatcacaaggtcaggagatcaagaccatcctggctaacaccgtgaaaccccatctctaccaaaaatacaaaaaattagctgggtgtggtggcgggcacctgtagtcccagctactcaggaagctgaggcaggagaatggtgtgaacccaggaggcggaggttgcagtgagccgagactgcgccactgcactccagcctaggtgtcagagtgagactccgtctcaaaaaaaaaaaaaaaaaagaattgtgggtgggtgcggtggctcacgcctgtaatcccagcactttgggaggccgaggcaggcggatcacgaggtcaggagatcgagaccatcctggctaacacggtgaaaccccatgtctactaaaaatacaaaaaattagccaggtgtggtggcaggcgcttgtagtcccagccactcgggaggctgaggcaggagaatggcatgaacccgggaggtgaagcttgcagtgagccgagatcacgccattgcactccagctgggcgatagagtgtgactctgtctccaaaaaaaaaaaaaaaaaaggaggggacattgaagcaacaacaacaaaaaaaagaattgtgcagtcatcaccacaattgcagacatttcccttgtaaaagtttccttccatctgtttgcagagtccctaccccaacccccaccctcagcccatcagcgatctgctttcttttttctttgagatggagtgttgctctgtcgcccaggttgcaatgcagtggcatgatctcggctcagtgcaacgtccgcctcctgggttcaagcaattctcctgtttcagcctcctgagtagcttggattacaggtgcgcaccaccacgcccggctaatttttaaatttttggtacagatgaggtttcaccatattggccagtctggtctcgagctcctgacctcaggtgatctgcctgccttggcctcccaaagtgctaggattacaggtgtgagccactatgcccagccttttctgtttttttttgagacagtctcgctctgttgccctggagtgcagtggtgcaatcttggcttactgcaacctctgcctcctggtttcaagtgattctcctgcctcagcctcccaagtagctgggattataggcactggccactatgccaggctaatttttgtatttttagtagacacggggtttcactatgttgggaaggctggtttcgaactcccgacctcaggtgatctgcccacctcagcctccaaagtgctgggattacaggggtgagccactgcacctggcctgctttctgttcgtatgtgtgtgtgtgtgtgtgtgtgtgtgtgtgtgtgtgtgtgtgaaaagtgtctatttgagtcttttgtccaattttcaaaaactggattgtttatcttacggagttgtaacaaagagttctttatgtgttctggataggattctcctgtcagccatgtgatttgcaaatattttctcccagtctggcttgtcttttaattttcttaatggtgtttcttttgaagagcaaaagttttgaattttgacgaagtctcatttactgctttttaagtggatactgcttttggagttatgtttaagaaatcttgggcccaggcatggtggctcacgcctgtaatcccagcactttgggaggccaaggtgggcggatcatgaggtaaagagattgagaccatcctggccaacatggtgaaaccccatctctactaaaaatacaaaaattagctgggcgtggtggcacacacctgtagtcccagctgctcaggaggctgaggcaggagaattgtttgaacccgggaggcgggggttgcagtgagcctagatcgcgccactgcactccagcctggtgaaagagcgagacaccgtctcaaaaaaaaaaaaaaaatcatacaggcggctgggtgtggtggttcatgcctgtcatctcagcattttgggaggctgaggtgggcggatcacctgaggtcaggagttcgagaccagcctggccaacaaggtgaaacctcgtctctactaaaaatacaaaaatgagctggacgcaatggcgcacgcccgtaatcccagctactcaggaggctgagtcaggagaattgcttgaacctgggaggtggagttgggttgcagtgagccaagatcatgccactgcactgcagcctgggcaaacagtgagacaccatctcaaaaaaaaaaaaaaaaaaaaagcgcaggtgcagtggctcgcgcctgtaatcctagcactttgggagactgagatgggtggattgcctgagctcaggagtttgagaccagcctgggcaacatggtgaaactccatgtctcctaaaatacaaaaaattagttgggtgtggcagcatgtgcctgtagtcccagctaattgggaggccgaggcagaagaatcgctggaacccggagcgcggcagaggttgcagtgagccgagattatgccactgcactccagcctgagcgacagagtgagacgccgtctcaaaaaaaaaaaaacaaatagaaagaaaagaaatctttgcctaggtcaaggtcacaaagattttctcctatttttttctagcattttgttgttgttgttgttgttggttttttttgagatggagtctccctctgtcacccaggctggagtgtagtggcatgatcttagctcactgcagcctctgcccgggttccagcgattcttctacctcagcctactgagtagctgagattacaggtgcgagccaccacgcccggctaatttttggattttttagtagagacggggttttcaccatattggccaggctgatctcaaactgaccttgtgatctgcctgccttggcctcccagattgctgggattacaggcgtgagccgctgtgcccggccttttctagaagttttatagttttagctcttacatttaggtctttgatccatttagagttaattcttttttttttttttttttttaattttgagatagggtcttactctgtcattcaggctagagtatagcggcatgatgtcactctagccttgacttcctggctcaggtgattctcccacctcagcctcccaagtagctgggttttcccagctatgtatgtgtaccactatgcccagcaaagtttttgtattttttttgtagagacagggtttcaccgtgttgtccaggctggcctcaaagtcctggactcaagcaatctgcccaccttggccttccagagtgctgggattacaggtgtgagccgctgtagctgaccaaattaatttgtttcacttatggcttgagataaagatctaaaccccccttttttgtggatggaattcaattattttagtatcatttgttgtagagactatcatcttcccatcaaattgcctttgcacctttgtcaaaaattagttgacctaagccaggcattgtggctggataacaaagcaagaccatgtctcttaaaaatcaaaacaacagcgacaagaaccccaccagttaaccatgaatgtgagggtttattttgggactctccattctgttccattgatttatgtgtgtcccagaagttctcaactggggcatttttgccctctcaagggacatttggccatgtctggagacatttgtgattgtcacagctgggggcatctgttgggtagaggccacaggacagtcccccacaattaagaataaatcggcccagaatatccatagtgcttagactgagaaatcctggtctgttcttagaccagcagcacactggcttgtttacagtagtttgatagtaagttgtgaaatcaggtagcataagttctccaactttgttctctttcaaaattgttttggttatgctaagttctttgcatttccatatacattttataattagcctgtcaattatttctacaaaagcagcctgcaattttgataagtattacattggatatataaatctatgtggtgagaattgctgtctttacagtgctgactctgggaatccatgaacatggtatatctctacattaattttgatatttagcttctcagttgtttttttttttcagataactttacctatttaaggcaagtgatatttgccaatctattactgatatattgccttcccaatctagtagtgataaaaaatttccttttttttttttttttttttttttgagatggagtcttgctcttgtcacccaggctggagggcaatggcgcaatcttgactcactccaacctctgcctcgcaggttcaagtgattctctcctgcctcagcctcctgtgttgctgggactacaggtgcatgccaccacgcccagctaatttttgtatttttagtagagatgggtttcaccatgttggcagggatggtcttgatctattgaccttttgacccgcctacctcagcctccggaagagctggtattacaggcatgagccactgcgcccggctattcttaataacagttttgttgagatctaattcacagcatacgagtcacactgagaacatctagtccagtggttttttttgtttgtttgtttgtttttgagacggagtcttgctctgtcgcccaggctggagtgcagtggcgcaatctctgctcactgcaagctctgcctcccgggttcacgccattctcctgtctcagcctcctgagtagctgggactacaggcacccgccactacgtctggctaatttttttgtatttttagtggagatgtggtttcaccgtgttagccaggatggtctcgatctcctgacctcttgatccgcccgtctcggcctcccaaaatgcggggattacaggcatgagccaccgtgccgggaccagtggtttttggtatacttgtgttgtgcagccatcaccactgtctaattccagaacatcttcatcacaccaaaaagaaacccagtggccatgaaacagtcactcacggccaggcgtggtggctcacatttgtaatcccagcactttgggaggccagggcaggcagattacttgagctcagaagtttgagaccaccctgggcaacacggcaaaaccttgtctctacaaaaaataaaaaaattatctgggtgtggtggcgtccacctttagtcctagctacctggtgggctgaggtgggaggattgcttgagctcaggaggtcgaggctgcagtgagctatgattgccccactgtactccagcctgggcagcagagtgagactctgtctctaaagaataaattaataaaatttggccgggtgcagtggctcacacctgtaatcctagtactttgggaggctgaggcgggtggaccatttgaggttaggagtttgagagcagcctggccagcatggtaaaaccccacctctattaaaaatccaaaaaattagctggacgtggtggtgggtgcccataatcccagctactcaggaggctgaggcaggagaactgctttaaaccaggaagcagagcttgcagtgagctgagatcacgccactgcattccagcctgggcaacagtgcccaggctttatttattgaaaaattaataaaaattggctgggtgccgtggctcacacctgtaatctcagcactttgggaggccaaggcgggtggatcacctgaggtcggaggtttgagaccagactgaccaagatggagaagccccatctctactaaaaatacaaaatgagctgggcgtggtggtacgtgcctgtaatcccagctactcgggaggctgaggcaggagaatcacttgaacccaggaggcagaggttgcagtgagccgaggtcgtgccattgcactccagcctgggcaactagagcaaaactctgtctcaaaaaatatatctatcaataaaaaaaattattattattattattgagacggagtctcactctttctcccaggccggactgcagtggtgctatctcggctcactgcaagctctgcctcccgggttcacgccattctcctgcctcagcctcccgagtagctgggactgcaggcgcccgccaccgcgcccggccaattttttgtattattagtagagacggggtttcaccgtgttagccaggatggtctccatctcctgacctcgtgataaaaatttttttaaaaagggcttgggtttcatagtaggatgcatttgaaggtaaaagcaatcctaacaggctgtgaaaattgcagctgccattgggggcaaccctgtaggcgtgtggtgggaggagcactagcttcagagtcctgggctgatggtagcccctcctgtgccagtgacttcctcagtggccttggccagtgttttgctcaatggggccccaggtttccctggctgagccctgggggtcacctctgattccctgggcccctttcaggtctggctgccagtccatgtgagccagcagggagggacaggccctggccctcgcccagcccagcccagcttttgtttttcatgatgcccagaagttttctggaaaatgttctgtatttcctggatgaccctgaagtggtgaccactcctgcctgcccacctcccagacccggtgccgcctgggtccgacattgcctggctttccccgcgcccttccgctgtgtcccgtgaggctctctagctttgcgctttggggtcatcttgtccagtggacgacggcgtggtgtcgtctgcaccatccctgcagtgcctgacttgtgctcgctgaacagctgtagaattacccggagctcagccctttgctgcgccctaggaggggctggaagaggagcggcctgtgtccctctgcttgtttgtggagaagctgacctggagcagtgttggaggggtccctggatcctgagcgagtgttcggtcatttgcctttccatagacctgggcgaagaagcgagaggtttgaggagtgactgaaatcaagacctgaggccgttagaagaaacaccgtttgctcagtcctttcatccagctcgcgggggacttgggtcctctcacgtggtcttgggtatgtggcctcagcggggcctggcatccctgaggtgggcagaaggttgcattggctccccagggctcagcactggcgccactgctcacataactgaagctttcttctaacagggctctcgccccgcggaacagatgctctctgtgatgtctctgagagcccagactcccagggagccttctggggaatcgaaagaaagaaaagattgcttcagtgctttggggaaaaagtgtgtgtgtacatatactgcacatagacattaaaaatcagaggctgggggctggctgcaggggctcacgcctgtaatcccagcactttgggaggctgaggcaggcggatcacttgaggtcaggagtttgaggccagcctggccaacatggcaaaaccctatctctactaaaaatccaaaaaaaaaaatagccaagtgtggtggtgcacacctgtaatcccagctgctcaggtggctgaggtgggagaatctcttgaaaccaggaggtggagttcacagtgagccaagattgcgccactgcactccaccctgggtgacagagtgagaccctgtctctaaataaattaataagtcaaataaaaaataataaattgaggctaacatattcttttttttttctttttttcgagacagagtcttgctctgtcgcccaggctggagtgtagtggcatgatcttagctcactgcaacctctgcctcctgggttcgagcaatcctccttcagcctctggagtagctgggattacaggtgtgggccaccacacccagctaacttttttttctttttttttgagacagagtctcgcactgtcatccaggctggtgtgcagtggcgcaatattggctcactgcaacctccacctcccaggtttaagcgactctcccgccaaagcctcccgagtagctgggattacaggtgcccactaccacgcccagctaatttttttttttttttttttgtatatttagtggagatgtggtttcaccatgttggccaggctggtcttgaactcctgaccttgtgatctgcctgcctcagcctccagaagtgctgggattacagatgtgactaccgtgcccggcctcagctaacttttgtattttctgttttttttttttaagtagagacagggtttcaccatgttggtcaggctggtcttgaactcttgacctcaggtgatccacctgcctcggcctctgcaagtgctgggattacaggcatgagccactgggcctggccaaggctagcatacatttaggaaatgtacagctcattaatgtgcagtttgataaatgatcacaaaatgaacatgttgagaaaaatagagcagtaccggcccccagaggccccctattgtccccttctgaacaacctgcctcccccttcttccctgggaaccacccccctgacttcctccctgggtgacttctgcttgggtttgagcttgaaagaactggaaggaggcgctcttcttgctccacctcaggatgagatgggatgcaatggccgggcggggtttgtgagcagtgagtgatctggcgtctgctgtgggaccttccagcgtcccagtgctgcccgtggacgggctccgggggagctggggacatccttgtgtctggcggtggtgcccttgagcctgatctctttgggtgcgtttttatgcctggagtggacttgttggggctgttgggtgcattcagccttcgtagattttaaacttttaggagtgaacgaatttgcatgtctgcaggcaagaacaagggtgttggtcgctctgcattcatactggcactaggtagggtgaggggtgtgtgctatttttaattttttttcaattccaccttgaatttctcattgtacttttccctgatgaccagtgaggttgagcgcctttctctatgcgaattggccatctgtttcttgtcctgctgttgaagtgccttgtgaagtcttttacacattaaaacaattgagtggccaggctcagtggctcacacctgtaatcccagcactttgggaggccgagacgggcagatcacaaggtcaggagatcgagaccatcctggctaacatggtaaaaccccgtctctactaaaaatacaaacaattagcagggcacggtggcgtgcgcctgtagtcccagctacttgggaggctgaggcaggagaatggcgtgaacctgggaggtggagcttgcagtgagtcaagattgcgccactgcacgccagcccgggcgacagagcaagactccatctcaaaaaaaaaaaaaaaaaaaaaaattgagtggccaggttcagtggctcacacctgtaattctagcactttgggaggctgaggcgggcagatcacctcaggtcaggagttgaagaccagcccggccaacatggtgaaaccccgtctctactaaaaattcaaaaattagctgggcatggtgttgggtgcctgtaatcctagctcctggggaggctgaggcaggagaatcgcttgaacctgggagatggaggttacagtgagccaagatcgcgccattgcactccagcctgagcgacagagtgagactgtctcaaagaaaaaaacaaaaaaaaaattgagttatctttttttcttactggtttataggagctctttcctaagtgctttttattatggttttaattctttggaaattggccgccttagtgccgtttatggaagctagcccaggcaagaaatggagtgtattgaaggctccgagggaagtcccagtaacctcaggggaaacggacaagtggaagctgcgggaacccagagcctctgttcggctccagcctcagcgccatcctgcagtcctgcagagcgccccagctgctccggcgtgtgtgaggccatcgccacccaccaggctggtcaagggccaagtgctgccgtcgtccctggtcccattccacaggagggagaattcggatggcccagtgtgccagtgtccaccttagggccaaccagccctgtctagggggtgggggccaccctgagggtggtggaggctgtttccagaaaaggggaggacacacccccaacaaaaaaggtgactacagcttatgccccctccgtgccccagcgtctttgcttagtcagagttgttctcagctttgtgttccgcactggaagccagagccctgtatttaatatggtatcacgtttacatatgggaggtccgaaagggacttctagccagtgtgttcacacctgccggaggctcctttgtgttaattggcattttttatcctcaggacgtcctgagtttagggtggccctctcatctcaagtttgcagttaaagaaatcaaggttgggtgtggtggctccctgtaatcccagcactttgggaggccgaggcgggtggattacgaggtcaggagtttgagaccagcctgaccaacatggtgaaactccgtctctactaaaaatacagaaaattgctgggcgtggtggcgggtgcctgtaatctcagctatttggaaggctgaggcaggagaatcacctgaacccgggaggcagaggttgcagtgagccgtgatcgtaccactgcactccagcctgggtgacagagcgagagtccgtctcaaaaaaaaaaataaataaatatctcagcccatgttgacttccccagctgggtgggggactggtagtaggcagggaagcatggtaggcccagggggatcaatgcgtgggtgatacagctgggtgggacccccagagcactcgaaggctgtggggctgccaccccctctggcctcccacctggtgggggcatcctgggacctgatcttgtgcaggtctggcccacctggggtttattggcaatgcagcagctgattttgtgagactggtaagcaggaacacctgtcctgttagaacacgaggagaattttcagcaggtggaatcagtgagctgttcggagcccctgcagacacctcgtggccttcccactcccccttcctcgggtgggaacgatggctgaggcagcccagtgaagtccacccctggtgtcccgggtccctgggccgctgtgtttcttaggaggcagacatgctgggtgtcttcattcacatcctggcttacttcccatggctgacagtgcaggctctggagtctgcccaggggtcccagtgagaatgtctctcactggttgtgtgacctgagcaggtcactcagcctcaccgggccagtttccctgactgtcaaacaccagtaacaacagcatctgctttcattcattaggtgagtgttcatccagctcttaggcatggagcggggaggtcatgaggatgcggggccgtggacagttgaggatgatgcctacttttgggctggggaggacagagggaaccaacaggtacacgagataaagcagcagtgacactatgaggagaatggcggcgggagcgttgaccacgagctggcagttggcctgcgtggtggtccaggctggcctcaccgcggcatcccaaggagggaatagcccaggccgggaaggtggggcggggtgggcagggcatgtggaatcactggtctgcagagcggggagcttggccatggccttcaggtcagggtgcagcaaccttcaccattgggcatcattaggctgggggcatctggaaggtcaggaggaagcctgggctacctaggatggaacaggcaggacagttgtctccaaggcctgcctatgacttgggcatcctgtccccagatgcacagcgtctgccccctcggtgcgggaggatgaggaacgcctgcctgtggatccacacatggtccccgtattgggggtgtggaggaaaggcctttctgacatgatctgagcccggcctctttctcttaggggtgtaccagggttggtgggtttggaggcaaatgcatttcaagggtccagatcacgaacctctgacccggtgggccctgaactctggtctgataaacatgggtcagacttctccctgaaaactgtgagcgtggagttcaggcacaggcaggcggggcaggtgctttcaggcttgatagcaagaccctactttactcatctgccctccacgctccgcggctccgacggtgtttgctgcggctcctctgctgcgttgagtccgtctgtgcactcagatggcctgtgcttcgcctttcgcccgcgttcttgggaggccttgccgcgtcccgggcctcccgcccttccaaggttggcttgtttcagtgattcggaatgtccctgttttcctctcgcagatgtctggtggcgttcattgcacactgtgtaccacaagatattgacaaggtgcaagagacacaagacgggcccagaaggcttcttggctcactctgtggcctgtatggaagggacagggctgtccccctcccctggccatccccaagacagcctctgacctgtggccttgtggttttggtttttctcagctgtagagatgacaaacgtatgtatcctcctgcctggaggcatgtgtggagagcattgaggctgttcggggaatgcctcgaggcctcccacggaagggattttgcagttttcatttctgtggctgttgtctccctgtgcaggttgcccggacacctgcaagccacccagagtccgaatccctcgggcagggaggcagtgaactgctgggctccagtccccctgggggtgacagtaaaccaggggagaaggatgcctttgttttagtggtgttcgaggactgccctgaggccctgggtccttgagtgtgttggttccacatagccgggatttccaggacaaccttgggaccctgtggcgtctgtcgggctctgtgagcccacaggaggattttcagccattctgctggggaagccccttgggtgtggttttttgtgtgtgaacagtgcccattgtcactggcgatgacaccactgactcctgtccccgtggtcccccggctgcaggaggggaggtgcccagcacagagactgagaaacaagtgggctctggagtcggggtgtgcgccccagctccaccgctgatgagcttgggggccttagccaagcttcgtttcctgtatgtttgaaagtgtgggccttgtctgcccctctttccttggggccagcgggaaagggggtgaaggcgctgacctcagcaggtgtggagggagagcctggtgggtgtggttccacctgcgttctttcacctccacagctgccttcccacttcccactcacagtctccttttctttttcctccacccccttggcagcgctgcctgctcctcttggtcctgagctggtgcacatacaaatgtacacagctcatgcacgcacacaccacatgtgtgtcattcttcttgaggcaaaggaaagggcggccccgcccctaacacttccccaggcctggtcccttcctcctgccccatcagggacctagggtctccttcccgtgtttcttctccatgtgtggatacccatgtgtgagcaataggattttttttttgttttttggagacagagtcacgctgttgcttgggctggagtgcagtggcccaggggcccaatcatagctcactgcaacctcaaattgctgggctcgcatggtccttctgcctcagcctcttgagtggctggtactacaggcacataccactgtgcctggctactttttttttttttttttttaagacagcgttttgctcttgttgccccaggctggagtgcagtggtgcagtctcggctgaccgcaacctctgcctcccaggttcaagtgattctcctgccttagcctcctgagtagatgggattacaggcacccaccaccatgcccagctaattttgcatttttagtagagacgggagtttctccatgttggtcaggctggtctcgaactcccaacctcaggtgattcgcctgcctcggcctcccaaagtgctgggattacagatgtgagccactgcgcctggccactttttgtattttttgtagagacagggtctcgccatgtcgcccaggctggtctgaaattcgtggcttcaagccatcttgcccaccttggcctcctaaagtgctgggattataggcgtgagccccctcggctggcctggattctctgtgaggtgtttccagttcttcccagttggtctcgtctcctgcaggtgtgagttgttgattgtctgcgccgtgttgatcacgtagaccctgttcttgagtgctgagggtccatccggtaaccctgcactgtcatgcatttccctgtcagcatatgacttggttccttttttttttttttttttaaaaaagaccgtcttgctctttcgcccaggctggagtgcagtggcgcgatttcagctcgctgcaacctctgcctcttgggttcgagagattctcctgtctcagcctcccgagtagtggggattacaggcatgagctaatttttgtatttttatttatttatttatttttgaaacggagtcgtcttctgtcacccaggctggagttcaatggtgtgatctccgctcacggtaaccttcgtctcctgagttcaagcgattctcctgcctcagccttctgagtagctgggattacaggcatgcaccaccacggccagctaatttgtgtgtgtgtgtgtgtgtgtgtgtgtgtgtgtgtttttagtagagatgggggtttcaccttgttgccagactggtcttaaactcctgaccttgtgatccgcccgcctcggcctcccaaagtgctgggattacaggcgtgagccaccgcacccggccctaatttttgtatttttagtagaaacagactttcccatgttggccaggctggtcttcaactcctgacggcagacctcaagtgatttgcctgccctggcctcccaaagtgctgggattacaggggtgagcaccgtgcctggtgggttataatttttaacgcttgaattttttttttttttttgttaaagggtctggctctgttgcctaggctataatgcagtggcttgatcagggttcactgcagccttgacctcccaggctcaagtgatccttccacctcagcctcccgagtaccttggactgcaagtacgcatcaccgtgctagctaattttttttgttttgttttgttttgagacagtcccactctgtcacccaggctagagtgaagtggcacaatctcagctcactgcagcctctgcctcccaagttcaagcgattctcgtgcctcagcctcctaagtagctgggactataggcacacaccaccatgcctggctaatttttgtatttttagtagagatgggatttcgccatgttggccaggctggtctcaatctcgatctcctgaccttgtgatccactcctctcggcctcccagagcactgggattataggcacgagccactgagcctggactaatttttgtatttttggcagagatggggttttgccatgttgtccaggcaggtctcgaactgctgggctcaagtgaacctcccaccttggcctcccaaagtggtaggattacaggcgtgagctactgtacccggccttgcttgatttttttttttttttttttttctgagacagagtctccctcactgcaacctccgcttcctgggttcaaggaattctcctgcctcagcccctcccaagtacctgggactacaggcgcgtgccaccacacctggctaattttttgtattttttagtagagacggggtttcaccgtgttagccaggatggtctccatctcctgacctcgtgatccacctgccttggcctcccaaagtgctgggattacacgcgtgagtcaccgcgcctggcaaaaatcttgtattgatcatattgtgtgtctgcaaccaaaatatgcgcaccaattgaaattagaattttaaataattttacatcataagctgtgagtttttcgtgttttgaatggccattactaatacccaattgatcaaacaaatattccagtttttatcaataacaagaagaaatacgaaaaaacattggaaatatgtctcttgagtagatgggttcctttttctcctggttaattcatgcattcacagttggatacaagctgttgctaaaatgatttcagcctcaatgctagttttttttgtttgtttgttttttttgagatggagtctcgctctgttgcccaggctggagtggagtgaggtggtgcaatctcggctccctgcaacctctgcctcccagatgcaagcaattctgctgtcttggcctcctgagtagttgggattacaggcatgtactaccactcccggctaatttttttttgttttgttttgtatttttagtagagatggggttttaccatgttggccaggctggtctagaactccttacctcaagtgatccacccccctcagcctcccaaagtgctgggtttacaggtgttagccaccgtgcttggacccctcaattaccagtttttttttttttttttttttgatggagtttcactcttgttgtccaggctggagtggacagctggcccaatctcagctcacggcaacctctgcctcccaggttcaagcgattttcctgcctcagcctcccaagtagctgggattacaggcacacaccaccacgcctgggtaattttgtatttttagtagagacagggtttctccattatggtcaggctggtctccaactcctgacctcaggtgatccacccaccttggcctcccaaagtgctggaattacaggtgtgagccactgcacctgggttctgttttttaagttgagaaaccttgataacatcaattagataggaattagcaagatttttatgtaacaatagcatctatttccaagttacttcacaaaaattgacataaaaacctagtacaaaaattaatgattcatcacctcacaacttacgtccttccagttaagtttttttgaggtaaaattcacttaccatggggacacctttttaaagtgtacaagtcagtgatttttggtatattcagtcatgcaaccattaccttgatctaattctagaacatggtcccagttttgtgatattacaaccattgctttaacaaacactcttcttccttgtctctaatcttttaaaaataatttttcttgttttacaaatgatatatgttaattgtagaaaacttaattttaaaaagataaaggaaaaaattaataatcacttattacctatgcaggtgttttagtttgtagcatttgtttctctgaagttatttatatgtatatatgcgtgtgcatatatatatagagtgagagttggcgggggtgggggtggtggtggggggacgggaagagagacagggtcttgctctgttgcccaggctggagtgcagtgtggtgtgatcatggcttactgcagcctcgaactcttggactcaagcgatcttcctgcctcagtgagtgtcctgagtagctaggactacaggcatgcgctgccatgcccagctaatttttaagaattttttgtagagacagcgtctccctatgttgcccaggctggtcttgaactctggggctcgagcgatcctcctgccttgatcttccaaagcgcccaggcatgaaccactggcccagcttaattactttctctgaagttattgaagcttaaaactacatacagtaagatcttagagcctccagcctagaacaccaggctgaaaagtgctgtggagaagaataaggctggaaaggggagtggaaagattggttggcaagctggggtgtgggaggcttggcaagttgtaaaaggggtgtcagaagaggcctcgtggagagagcagcctgaggtagagctggagctccagggaagagctggatgagctgaggactccagggccccgaggtgtgagtgggccggggctggcagagtggccttgtctggggcctcggaggctactgggacctgccccagtgtggctgggacgccagcagagttttgagggcagtgggtccagaaacaacagacctggggacccaggggatgtggggaggctggtgaatgggcacagtcacagggcagatggtgccagaggctctaaccagtgctgtggttgtagaaatgaaatcgaattgggagtcaggagaggagaaatgacagtcacgtagaccacgtctcagaaagactcgacgtctctttctgggtgactccttcagagtgtagtggcttagcacagtgagcacttcctaccttacggtgagggtcgggattgggagcggctccgtcggggggctctggctcaccatcactcgtgagtcctcactcaggctgtgtcacggtggctcacgcctgtaatcccagcactttgggaggcaaaggtgggaggattgcttgtgcccagcagtttgagaccagcctgggtagcatagtgagaccccatgtctacaaaaaataaacaaaaatgagccagacattgtgcacactgtgatcccagctacttgggaggctgaggcaggaggattgtttgagctcaggaggtccaaggctgcagtgatcgtgcccctgcactccaacctcggcgacagagcaagaccctgtctcaaaaaaaaaaaaagctgtgggtgggctgtggtcctctgagggcttgcctgggcatggaggggctgcctccctggctcacaggcccggcatgccggtgctgggtttagcgggaggcctcaggtcctcccctcgggacctctccatggggctgcttgggtgtcctcacagcatggtggcagcttcccccagagccttagaagccacacaccatcattttcatgcagtctctgtggtcatcatttcatgcggtcacctggtcagccctgttcagtgtgggtgcagtctgcccagagacatgtcggccgggaggtgagatgcgctgggggccctcgtggaggctggccacctcgctcatcttctgcctacagcgggggcttcttggacacaaagtggttgtgccttgaaggtgccctgggaggaggttggagcaggaggcttctggaccagggacctgtctcctgcctggggccatggagtgcccagtgcctcggcctggaaggcctggcagggacaagcccgctcctgagtgtccctccagaccaaggctgcccggccttctggaccccacctcagtacgtcagcgctggggagagcctggaagggtgggggctgatcactgctaagggtgcccccgacgatgggtcctgggctggtcagcagggtcactgggcttcccacaccctcttgccgtgctgctgtggcccttgtctgccagcagctagtgcgggggttcccagcagccgagtccttcatgtggttttcatgaacatggtgcacatcttggaggagcaggcaggtggctctgggccgggccctgtctcagccctgctccatgactggggcttgaggttggtctgaggccagcatccggagaccaccgtgccctgaggcacggggtgccttgtggcccctggccccgccccgtaggctgtgtggaaaattcacctttaaagactttgtgtatttcaatgtggtggggctatgttcaaggcccaggtaatcagggaaggcatcctgggctcactgtactgcaggtgttctttctttcttttgatttaaaaccaccacataggctttgctccacccctcgtctgctctgcaccaatttccctggcagccttgtgggcgtgtccttccagaacattctctgtgtattcacaatttgtgttgcgcacatctcagtgcgtgcggtgacccctcagaaaatgatcttgcagtgtgttaacttgttttctttaacctgcaaatactctgtgactcgctccacatcggtatgtctggatcagcttggttccagcagctgtgtggtgggccataaaatcagggcgtcccacttgctgaagcagttgccgctttcttctttgtttttggtcgtcatcagctctcagtggtccctgttctgcatgctgggttaggtggggctgcggctcccaaccactgttcctggcagtcagcagccatgctgggcacctggctctgggccacctccctcaggaggagcaccctggaatcactgttggggcccggctggtcttggtggccgtggctgtgccaactgtaactggggccgtggttctcgggaaggacacagaccatgcagcgcctgaaggtctcagaattcccgctgaaggccccgggaagggcccacctggcctcaggtgggaattctgagaaggaatagggattctggggcccccagtgggaattctgagaattcccagaagtccctgcaatacgtgaggttgaggaccatgtattctgagcatccttgaaatccacaggtccctgcagctacccgggtcctcccctcggagactcttcccgtggtcacccggctcctcctcccggggactcttcccgtggtcacccggctcctcctcccgcgggctcttcccgtggtcacccggctcctcctctcggggactcttcccgtggtcacccggctcctcctcccggggactcttcccgtggtcacccgggtcctcctcccgggggctcttcccgtggtcacccggctcctcctctcggggactcttcccgtggtcacctggctcctcctcccgggggctcttcccgtggtcacccgggggctcctcccggggctcttcccgtggtcacccgggtcctcctcccgggggctcttcccgtggtcacccgggtcctcctcccggggctcttcccgtggtcacccgggtcctcctcccgggactcttcccgtggtcacccggctcctcctcccggggactcttcccgtggtcacccgggtcctcctcccgggggctcttcccgtggtcacccggctcctcctctcggggactcttcccgtggtcacccggctcctcctcccggggctcttcccgtggtcacccgggtcctcctcccggggctcttcccgtggtcacccgggtcctcctcccggggctcttcccgtggtcacccggctcctcctctcggggactcttcccgtggtcacccggctcctcctctcggggactcttcccgtggtcacccgggtcctcctctccggggctgtgtgccaggagaaatggggctggatctgggcgtcaggtcaggaatccaggggagaggccatgctctcagtgttccttggcagggctgtgagcgcaggtctctgaggatgcccagctgtccatcccctcctcataggagaagcgcagatctcatgcctaagtgtgccagggtcctgatgggcgccacctacagcctcccgccctcacgcgggagtcagactgaacgaactagcccagatccacagagacttctaaacccggctgggtgctgccatggaaagtacacagggctcagatttgggggtaaggtgacttagcctggggtcacgaaatgtgtaaggatttcttggggtggctgtgacaaatgacctctaaccgtggcttgaaacagcagaaatgtattctctcaccatcacagaggcacacgtcagaaaccgaggtgccagcagggccacggtccccgaaggcgctgggggaggactcttccttacctctccccactcctggggccccaggcactcattgtcatccctgggcttgtggccgcatcactgcaatctcttgcctccatctcttcccttggccttcccttcaagtctgcgtccaaacctccctctcctttcttctgttaagaaccagtcactggatttagagcccctcaatccagtatgacctcctcttaacttgattacatctgcaaagaccctagatccaaataaggtcacatgcacaggtaggggctgggtgtggagtaggacccgaacttcatcggaaacacagctcaggccactacagaagaaagtggtgttggagctggatgctggctgatgggctgggagcagcgaggagccgtccagggaagggtgttgaggctggcagtgtggagaggccaggaggccaccttggaaggcccgaggccaggtggccgaggcagagggtatgaggggcacccgctggcctgtctgcatcagctcccctcaggtggagcctttctcagggccgagcttcttggccgtcagatgttcccaccaggctgtgttcagcctcagagtcgataactgtttccaggctgggcgccgtggctcatacctgtaatcccagaaccttgggaggctgaggcgggcggattacctgaggccgggcattggagaccatcctggccaatatggtgaaaccccgtctccactaagaatacaaaaatcagctgggcgtggtggtgggtgccggtaatcccagctactcgggaggctgaggcagaagaatcgcttgaacccggtgggcggagcttgcagtgagctgagatagcgccactgcactccagcctgggtggagcgccactgcactctagcctgagactctgtctcaaaaaaaaaaaaaaaaaatctataatcgtgtttccttttttaaacaggaaactactttgcttcgcactttttcatgggaggagagaaattcgacaccccccaccctgaaggttacctctttggagagaacatggatctgaacttcctgggcagccgcccggtccaggtgggtctggacagggctgtctcatggggctgtgggggtgggaggcccctgtccccagcagtccgcatcccagccatgagggcaagcaggcaccaaatcacccctaaagggggcagagctcctggcaggattccagttgagcttgggtgtgggcacgtgccctggaatgggttgtgtcctggtgctgccccctagaggccagatggccaggggcaggtcactgagaaacagagcagccatactgaatgggtgcgtctgggctgcaacggctgcggaacatggtggatttgattccagccttcttggatgactttctttacaaggcaaaaatagtatttacagactgggcattgtggctcacgcctgtaatcccagcacttggggaggctgaggcgggcagatcacctgaggtcaggagtttgagacaagcctggccaaaatggtgaaaccccgtctctactgaaaaaaaagaaaaattagccgggtgtggtggcacgtgcctgtaatcccaactactcgggaggctgaggcaggagaatcacttgaatctgagaggcggaggtggcagtgagccgagattgcaccactacactccagactgggcaacaaagggagactgtctcaaagaaaaaaaaaaaaaagaatatttactttccctagaacagtgggcaagagacatggtccaaaggagagatgcagacagctggctaacatcttcccctcgttgccagagaagggcacattcgagtactgtcatagtactcgagtactgtgagctgtctgttcagcacacatgtggcacctgctgcgtgcctagtgctcttccagggcttggggtgaaagcagaccctgcctctgctacctggtgggggcgtagacaattaatacgggacaaatgggtagaagagagaaggggcagaaagggaggctctactggagaggccatggctgaaccaagccatgataggtgggaagggggcccctccagaagaagctagaaggcagggggcctgggaacagaggaagaggtgagagggtgcaggcctcaggggacaggaggccggaagagccagtaaactttgggggccctggggcgggttgctgagctgtgctcgtaggaagctttggggatggaaagggtggggactgaggaaggggctgagggtgctcggggcagtgatggatatgggaagcctgggagagcaggttggggatgggcagccccagcgtgcaggggtctggcgttgaggctgcctggctggatttgctcagggtgatttggtcctggccgttgcgtgtgctggctgcgtggcctgcagcttctacctgtaaatgagaacagtgcacccagtatagcccctcccatgggactagatcccagggataccctctggggctgtggctgctgcaccctgacccgttttctgttgttggctgctcctgagggagtcacctggggccctgtggtttttctcctagtttccctacgtcactcctgccccccacgagcccgtgaagacgctgcggagcctggtgaacatccgcaaagactccctgcggctggtgaggtaacttcaccctgcccctggggaccctgtggctctgtggggcgcagcctgtggtggaggttctggcttgatgcttgaggaaaagggcaggcgggaggggccccagtttctgcgccctcccgtgtggaatgagaggctgtcctgggctgagcgagggaaagggcatgtggaacaagagccgtttagccagggcttctcagctgtgccgcacagggaccctgggcagtgtctggaggcagccaggtggggtgcttggcatctcaggtgggtgccaggggtgctgcagacttcctgccatgcacaggacggcccccccacagacaggaatgacccagcaccagatttcagcaggttcagaaactgcttaaaccgactagacttgaggcatctggggctgtctctgaaccaaaagcacgtaccccgtcttctgtgggcaggaagaaggagaggcaagccctggaccactgggctttcatgtacaaataggaaacagcccctatgtctactggagaagcgggctgtgtccacatagccacctccacggcccctcagcctggcaggggaggaggcagcctccgcagatggggccgctgacccgctgcctttctctccaccgcctggggtaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtgtgagtcccgcgggcggctggcaccggcctggctgggggccccagactcctgggggaggcttctgtccaccttactaaccagagggagaaaaccaaaccgtgctctttgaccatactcccaggactttaccacgatgtgaggggtttctcccaccccagggactccccacttttctgcgggaaccagctggggtcctttgactggtttcagttccaacgctgcctggaggtcatgcaacccctgcactttgagggcccagtcccacaagactgccccacttcagatgccactcataagcccccgctgtcacctgaacttctcagcaaccagccataaatcaggctcccacagtcccctcctcaggcttgatgagttgctagtgtggctcacagaacccagggaaacacttggctggtgtttgttggtttattgtaaaggattcagatgaagaggttcacagggtgaggtgtgggggaaggggtggggcgcaccaccttcctcgtattcagcaaaccagaagctctcctgaaaaccccatttcagggccttttctggaggcttcatcacgtaggcaggattgatgattaactccatctccagcccctgtcccctccctggaggatggggctgggctgaaattcagttccaggtttttgttttgtttttgttttgttttgttttgagacgaagcctcactctgctgcccaggctggcgtgcagtggcacaatcttggctcactgcaacctccgcctcccgagttgaagcaattctcctgcctcagcctcctgagtagctgggactacaggcacgtgccaccacgcttggctaatttttgtatttttagtagagatgggggtttcgccatgttggccaggatggtctcaatctcttgacctcatgatctgtccatctcagcctcccaaagtggtttttgtttgtttttgagacagagtttcgctcttgttgcccaggctggagtgcaatggtgtgatcttggctcactgcaacctccgcctcctaggttcaagtgcttctcctgcctcagcctcccgagtagctgggattacaggcatatgctaccatgcctggctaattttgtatttttagtagagacggggtttcatcatgttggtcaggctggtctcaatcgctcgacctcaggtgatccacctgcctcggcctcccaaagtgctgagattacagccgtgagcccccatgcccggcccacctggcccaggtttttgtttgtttttcctcgggagctcttagacgacacttccaagtctctaatcatggcttggtctttctggcagccagccacctccaggagccaagagtcacctcactggcacataagacactcctaccacccgggaaattccaagggtttggagttctgtgttgggagcaaaggtcaaggaacaaatattagaacaaaagaggctcctagcacccctgttgctgaggaaatgacaagggttttagaggactctgtgtcaggaactggggctgggaccaaatatttattttttattgtgtcataattagatatttgtactttcagaggttttatttgagataagggtccttctggccctgaaagtttgaaaactgcaacttcagcaggagctggcaggactgcctccaggctacaagggcacatgtgccccaagtggctttagagacaggcaagagcgtgccccctgccttcctgcactggagcacaccgctcagtggtcagctttgcatctggggatagggtgtggttgagagcctaggctttgaatgctgtccccgctgagtggcttgggggcacatgactgcttgtgcctctgtgtcctcagctggaagttcgggtgggtggtgtgaggaggggaccatgtgtcctgtgcacagcccctcgcgtgacaggtgctcttgaaaggagcctgagtgctcgagttgaggggctggtggagacgacttatgtggggaggttcttagggacctgccaccaggtgaggccgcccttgggctctggccttgggctccccggcagccagggctcctcctgtggagcagcactttggggaggaacaggttcctttttctagactttgttctttgaggctctaccttgccccggcacttgattatatttctttaatgacactagtaatgcatgcctgtgtgctatgacaggcgtcgaattcttgggcgtaggagcatttggagtgaccagggcaggcccctctgtcccctccttgcaccccactgcttggggttgagtgtttgacacccacggggcctggtgccctcctcgggcctggccgacatggtggaggagctgggttgtggcgaggtgtccaggggctgccacagagagggtgtgggctgaggacacaggccagtgtaagttgtctatccgctgccccccagtgctccagctgtcaggggctgggtgaccatctcaagtgcacttgaagagagggtcccgctgctaccagaaaggctagagagagcagagagggtgccctgccagccctggctggtgtcaccctctcctagacccctgcgggctagtgatgagagaaatgccacagtccccccctctcaggacctggcacaaggccagcttcccctcccagcaggaatcacagagcaggaacagctccagtgccactgtccccctctgtcaggacctggtacgaggcctgcttcccctcccagcggggatcacagagcaggaacagctccagtgccactgtccccctctctcaggacctggtacgaggcctgcttcccctcccagcaggcatcacagagcaggaacagctccagtgccactgtccccctctctcaggacgcggtgcaaggccagcttcccctcccagcagggatcacagaaaaggacctggaggctccaggacctggaggctgtgcccaggcacccggacaccatccagcctgccagtgctccatccatttgagctgcagggcaagccaccctccctgcctcctgacaaggaaactgaggctcagacagaggggtgtgtccaggcctccgcatctcacaggagaaggctggggtccacctgagggtggcgtcttaactgtgccttttactgaggctgagcccgggcctcccctgtagtgcctccaaccatgctgggctctggcggccatggcaggcctcttctgcctttgtgtgtacagtggtggcccccccacgccccatcccatttctgagcttggtgtgcctttgtccaggagagcctgtggagccctggccacaggcaagcagggcggtggggtggaggggaggggctgtggattgtgaattgggttcctgcatggagttttatcagaaatgaaactgcttgaggcacctgtcttagggatgcactcgtgcctgtggctaagacatgcagaagggcggtccttgaagcagtgttgggaaaagtgagatgttggtgaccatctgctggtgtcccccaggggccctgactgaatcagtaaaaccaaagcgggacctgtgtggtggttcacaggacacagcccctgatgtgtgcagacgcatgaaagagcagtgttgacgcctaccccgtctgaacgttgaggaagagagacccgcgctgcatgtgggcaccattgtgcctccgccttccgggagtgatctgtgggtctctgctggggcggacagcaggcctctgggagcaggcgtgagggttggggaagatgcattttgcactgtgtatacttaagtactgtgttcatttaaaaagtaaactcaagctgggtgcagtgactcaggcctgtaatcccagcactttgggaggctgaggcaggtgcatcacttgaggtcaggagttcgagaccagcttggccaacatggtgaaaccccatctgtactaaaaataaaatattagcctagcatggtggcgcacacctgtaatcctagctacttgggaagctgaggcaggaggatcacttgaactcagaaggcagaggttgcagtgagctgagatcacaacactgcactccagcccaggcgacagagcgagactcttatctcaaaaataaataaataaataaataaataaataaataaataaataaataaacaaaccaacttagcaccgatggaaaggaaaagcacagctacactggggaggtatcaaagggattgggcaggtgtgggctctgggagaattgtagccaggcctgacctggggagagctgcatggtgagcagagaggccgtggaaggccctggaagggtgagggccacgtggccatgtaggctgtttgctgttccccatgagagagggtccccaaaagacaggtgtctgcggcccttccagctgtcggagtgggagggacgggcacggagggccctcttcctgccgcagcctcactgcttgctcctggctccctgcagatacagccccaagagcccctcgctacagtccgagaccgtccactacaagagaggggtgagccagcagttctccctgccctccttcaagattgacttctcggaatggaaggatgacgaggtaatgctggctgggcggctccttgcccttcgctcctcctgaattctctccccttgggggtggggccagcacagtggggtctgtgtgtttggcttcctccagggttcataagacctgggaacggccgccccagtctgtgctcaggtggacgtgtggatgggcgggagcaaggcctgggccatgtgctgatggggccaggggaccagaggccgaccaggcagccgcactcggaggctcagacactggggtttggggagatgtgaagaatggggcaccccctgccaggctgcagcaatgcagggtctgttcacaccaggtggcattccttcaagctttttaaccttacttttgtttaaaatcttggtgcagacatcctttttttttttttttttttttttttttgagacagtctcgctctgtcgcccaggctgcagtgcagtggcgcgatctcggatcactacaacctctgcctcctgggttcacagcattctgcctcagcctcccgagtggctgggactacaggcgcctgccaccacgcccggctaattttttgtatttttagtagagacggggtttcaccgtgttagccaggatggtcttgatctcctgaccttgtgatccgccggcctcggcctcccaaagtgctgggattacaggtgtgagccaccgtgcccggccattgctgcagacctcttttaaccaggtcttttgtaggttgcggcttgagtggctgctttgctagttgctcctcctaggcccctctccagcttttagtcaaagctgtgtcctccctccttccccctttgccttgttttccagcgtccatctggtctgcagcttgcaaagaccctggtccagggggttcctgtgtaacagtacagaccttgtgtggccgggcgcggtggctcatgcctgtaatcccagcactttgggaggccgaggcaggcggatcacgaggtcaggagatcaagaccatcctggctaacacggtgaaaccccgtctctactaaaaatacaaaaaaattacccgggtgtggtggcgggcgcctgtagtcccacctactggggaggctgaggcaggagaatatcatgaatccaggaggtggagcttgcagtgagccgagatcacgccactgcactccagcctgggcgacagagtgagattccgtctcagaaaaaaaaaaaacaatgtagaccttgtgggtcccaggtctgaggccaggaggagacactgaccacatgccctgctagcaggcctcatgagctgacttacgctggggccagtcctgtggctgtgttcctgacgtttagccactctctgtaaaaagcctcccttgtccttgcattaaaaataaaacaagccaggtgtggtggctctcgcctgtaatcccagcacttcgggaggctgaggtggaaggatcatttgaggccaggagtctgagacaagcctgagtaaaaccttgtctctatgaaaaatacaaaaattagctggatgtggtggtatttgcctgtagtcccagctactgaggaggctgaggtgggaagatcgcctgagcctgggagatggaggctgcagtgagccatgatcgtgccagcgcacttcagcctgggtgacagagcgagaccctgtctcaaaagtaagactacctgggagtgggggaccaccaggttgtctaaggaggggtgaaaaccgaacagatcaaaactcccatgctgatcagtagtgggattgtaccttggaatagccactgcagtccagtctgagccacatagcgagactccatttcttaggaaggtaaaaaaaaaataaaaataaaaataaaataaaagtaaaataaacgtctccccagactccctcgggtgggtggagtctctgtcctctcccggcatcactggcgtggaccctgcaccctgctctcacgtgtgactgtgggtgctgtgtggcgtgtgtgctgagctctggggagtgggagtttgggaggtgtctgtgtttcctgtttgtttcatgtttcctggggtccctccccagcccctctggggagccccagtctccgagccctgtgagccatgggtttgcaggtgaggtggccggggtaggggagtggtcattgtggccagcttcctgaggggtacggtgtttagggcccagagagggttggaatcacgatgcccccagttgtccttacctctgtcccggacttggcactggacccgccagggggcctttggtgagggtttgctgaggaagctgaaggagggcccgcgtgcagcatagtgctggctcgtctgtggatggccacgctgagttggcgcacataaggggcagctgctgctgcggggccttcaaggtgctatccttgtcaggacttttgtggatgcaagtgacagaaaaacatttggtctggtttaagaaaagaaaaccagagacttactggtgtagattcagagaaggctgggtggcctgagatttcttccagggcctgtgtcatcagggtggggatctctgtggcttagcctcccatctccctcagctggccctgctccagcgcgtggccatccggctgggtccggagatgcttggaggccgtgtgtcttctctttgtggccccatttggggcgggggcctcccgtcctgcagccaggccgcagagacctggagtaggagggagacgcttccccgaagagaacctgaggggctcagatgctgggccaggcatggcttagcatcaagagcgcagctgcaaggacaggccacaggggtgcccagcatggctgcactggccttgcccaggagcagagaggacatgtgtggaggggctgggggcccactttcgttctgccgctttttctctctagagtgttaggccagttctgcagctctgtgagcctgggtttgcccctctgtagactggggctggaagcagtccctcgcagggtggccacgaggggtccgtgatcagcatgcaaagggctttacctggagccgcccactgtaaacccgtctgccagccggggagtgggagagaaggctatagccaccatcttgcacgcctccccagaccgttggtttttattccacaccagtaaagcactgtcagcacctagtttctgcagtgtgatgagaaaaaaaatcacagctcactcagaggctcctcagagcacagagcggcccacgccagtgctgaggtgctggctgcgcggatgcattccaggcctgggcagaagcgaaggggtgggcaggggcgcgggggtggatgcgctccagaaagctctgcctcccccgtttggctccatcacctaaaggagtggctgccggtgcgcgaactccccatttccgggcttcatgacagcccttgtggcagcagtgtgggagcgttgccaggcaaccctgggacgatgactcctgtgtggactcagtggagtgggcaggaaacaggctcacaaggggcctacagtcccagcatgatcagccctgacaggccccccagaccggggaagggagtgtccctcactctggcaagcccaggtgtctgtggtatccctcagacggctgggagctggaggcctagctgggtcccagtgggtgtgaacatgtgccccacgtccctgcagccttttatttttccccctttttttgagacaggggctcactctgtctcccaggctggagtgcagtggcacaatcacagcttgccgcagcctcgaactcctgggttaagcgatcctctcacctcaactttcacagtagctgggactacaggtgccacaactactggctgatttttttttttttttggtagagacagagtttctctatgttgcgtaggctggtctcaaactcccgggctccagcaatcctcgtacctcggcctcccagagtgttgggattataggcgtgagccaccacgtcaggcccaccagtctgcagctttctgatgtgtgtggacgttttcacaaagccgtggcccaggattggccgccttggccacctttcgcacccttttctcctgcaccctccagccctctcccggaggaggctgggtcggctcctgttgcctggacacacagggcttcagggtgctggtgttgactgtgtgttctgccagccacagcacttggagctttgtgttaggcacggcttccgttccattttgccaaatggggaaactgaggctcaggtggggttctaattgtagtgaatgggtgaggagctagacttgatgccggcagccttgactctggccctgggccagtgccctgccagctcctggctccacccttcctcactaacagagaccacggcacttctcagccttcacagcatagcccccagcatcagtgtctctgtccacctctgtccatgtgtgcgttgttgtccatcccatgggacttgtggctggaacccctgacccttcctcgtgagatgcggggcctaggtccgtgtggacttggtctccaggcttgtggtttgttcagcagatggctgcctgcccagggcttcttgtgtggatgggttacgtgtgccattcattctggtctgaatggaactcttagctccagatggcaggaagctgcggtagccgtgtgccaggtgcctgtgggtatggagtccctgctgggtggggacatgcctgggaacgccagggtgctgccagcctttgccgtgtgtccatgtccacatagcctccctggttcgcagtcgggtactttcttgacactgatgtttgtccccgtccccttctcctgactgctgtctgtggtccgctgtaactcctttcttctcgtctgtatttttggtaggaaattcgctgtgttgacaaatgttaggaagaaacatttccctcggttccttaaataatagtaatatttggccgggcgcggtggctgacacctgtaatcccagcatttttggaggctgagttagtcggatcactggcggtcaggagttcgagaccagcttggccaacatggtgaaaccccgtctctactaaaaatacaaaaatttagctgggcgtggtggcgggcgcctataatcccagttacttgggaggctgaggcaggagaattgcttgaacccagggggtggaggttgcagcgagccgacatcctgccactgcactccatcctgggtaacagatcaagactctgtctcaaaaaaaaaaaaaaatcataatagtaatactcacaacaactgtagcagccaccacaggcagtgtctctgtgctgggtctgtcgagaggacttcatttgcgctttatccttgaaacccatgcggtagcgtggtattgaccccattttacaaggaaagaagccgaggctcggagggaggagggcctgagatgaaagccaccctggtcactggggtggggacgtgtgcccctgccctgcttccgctgcccacttcacggggggacagcaggggagaggagacatcctatgtgtctgttggttctgagcattgctgttcaggggcgggtgcttggctgcgggctcagggttcccttgtgctgggccaggagtagtcccacctggacatccgtgggggtggttgctgcagacatggaggggcttgtcccttcctcatgggtcttagtcagtgaggcctgtggtcggtcttgggaggcaggaggctctcccctcacccaactgcccttgcctgggctgggcctgccaggcctttcctatttgatgtttcatccatattttgtttttgtttttgagacggagtctcactgtgtcgcccaggctggagtgcagtggtgtgatctcggctcactgcaatctccgcctcccgatttcaagtgattctcctacctcagcctcccgagtagctgggattacaggcatgcgtcaccatgcttggctaatttttgtatttttagtagagacagggtttcaccatattggccaggctggtctcaaactgctgacctcaggtgatccgccacctaggcctcccaaagtgctgggattacaggcgggagccacggcacctggccttgttttttttttttttttttttttttttacacctttattgtgttataattaccatctcctgcagctcactcgtgttaagcgaatgattcgctggcttttagaatgctcacagtggcacagccagcatctgttctttcagtaaatcttcattgagaaataaatgattctttttcttcccagaataaacagatgcatgtgtccattgctgttctgtgccagacaccgaggatgtcatggtgactggagaggcagggtccctgccctctatggagggagtcagggagcctgatggtggccggtggctttcctggttgccagggtatgagcaatagaagcccaggggcgaagtgcttcctgaggcccagagaaggacgtggcctgtagagagtagggcgagacccacagagcagtgctggggagcaggggtctgagaggatggcactgtgctgggctgactgctggggccctgggggccgtggggaagagggtggccttcagcctgtgcacagcagggggtgggatgaacgcaagaggaagcttctctttggactcaagccagcctcgtggtctcccttgcttgccttttgtgtttgctggggccaagtccggtgccttcttcagaaagttacagggagttgcccagtgaccagcacttcccctcagaggcacgcacccgggagaactgaaaacgcggttcaggcagacacttgcgcaccggtgtccagtgcagcgctgctcaccgtagccaggacacaggcccagcccggtgtccgtcgcaaaggaacgcgtgcacagcgtgtggatatccacacagtgcctgttatttggccagaaaaaggaaagcagcaccgatgcgtgctgcaccgtgggtgaactttggaaacatacctagacacagaaggtcacctgttgtgcaattccatgtaaatgacaggtccaaaaatggcaaatccctggagacaggaagcacatggtggctgccgggggctggaggaggggatggggagtgtgtgggtgctgatggctacgtgtggggtttccgtttggggtgatgaaaagttctggaaatggatggtggcggttgcatgacattatagatgtactttactcaacgctgttgaaacgtagttaaaatggcagattttgtgttgtatctgttttaacacacacataaaaaaggtgccaagcctggcatccgccttccctgccatctcgaggcgtgtcctctgagctctgctgctgcctcctgctcctgcctgctttgtccagctcatttgttgaccgactccaggcttccaggcttggctgtgtgggtcctgaccattcttggcaactctctcctcagctgaactttgacctggaccggggcgtgtttccagtagtcatccaggctgtggtggacgaaggagatggtgagtgcgtcctcttccgtcctcctgggcgtgcaggccgtgcagggaggaagcacgtcttgagggaggagtgcttgcagcagtgatgaagcaggccaggcatagggccttgggcttcccacagggcagggtgtgagcagcttggagtcccgggcaggtgaggaggtggaaagtgcaggagggcaggtcccagaacaggctcaggactctatggactctgtgcaggctgagccctcggtgccgcaggcctaccagggtcggggaggtgagatgcctgggtggggcaggccccgactctgactactctgcccctctctccccagcagtggtggaagtgactggccacgcccacgtgctcttggctgcctttgaaaaggtaagtgccatctggccatcactttcccggggacctgggagctgggcagggggtggccttttgagacgagaagcctgagcaggggctggggcttggtggggtggctgagtgtcaagggccccggggcaggttggggcgtgtctgtggcttcctgctttctagcattctggtcctgaggccgagtgccgctgtcaggaggcttagcatttcctttttttttttttttctttcctgagccgggctcactctgtcacccaggctggagttcagtggcgtgatctctctcggctcactgcaacctctgcctcctgggttcaagcgattctcccacctcaacctcccgagtacctgggagtacaggtgtgcactaccacgcctggctaatttttgtatgtttagtagaaacagcgtttcatcatgttggccagactggtctcaaactcctgacctcaagtgatccacctgccacggcctcccagagtgttgggagtacaggcgtgagccacgtgcccggccttttttttttttttttttttgaggcggagtctcaccctgtcatccaggctggagtgcagtggtgggatctgtgttcactgcaacctctgcctcccaggttcaagcgattctcctgcctcagcctccaagtacctgggattacaggcccatgccaccatgcctggccaattttttttttttgagacagagtctcgctcttttgcccaggctggagtgcagtggcatgatcttgtctcactgcagcctacgcctcccgggttcatgccattctcctccctcagcctcccaagcagctggtactacagatgcccgccaccatgcccagctaatttttttgtattttcagtagagacagggtttcactgtgctagccaggatggtctcgatctcctgcctcttgatccacctgcctcggcctcccaaagtgcttggattacaggtgtgagccaccacacctggccatctcttttcttttttttaaacagggtctcgctctgttgcccaggctagagggctgtggtgtgatctcagctcgctgcagccttgacctcctgggcttaaggagatcctcccacttcagcctcccgagtagctgggactataggcatgcaccaccacgtctgtctaacttaaaaaaatttttttgtagagaagaggtctcgctatgttgcccaggctggtctcaaactcctggcctcaagtgatcctcccaccttggccttccaaagtgctgggattacaagcgtgagccaccgtacctggccaagaggcttttcaaagggtacttggagtgtgttgagggagaacattgtagactgaggccagccctgtagaattctgtagagcctgctgccatgccacgggctggggctcccacaaggagggctgtctgcggtagactgccttcgccctggggtgtgcagagatcagcaatgttgttacctcctcgggctgtagctttttcctaccaggctcagtgtccttgggtgtcacctggcacatgtcacagacccccagtcctgctgctccttccgccacctgcctgcggcactctgaccctgcaggctgggcaggccctgcttcctacaggagccttttcctgacaccactcaggacaaacatctgttgttcccacttgatgttcacgagggcagcactgtcctcttgggtgtcttggcatccccagagctgagtttgatgtctggcacagagcagacactcagaacactggcaggatggacgaggggttgctgcccacctggcatgggtttctgctgagaacctggcggaggtggtgggacgcacgcttgtttgatagtgccttggtgcctcggtggccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgggtcctgcctagcccaggctctccacccacctccagccccatgtgcagccgcagcccctgagagctctaagtgcagagtccagctcttacctgtgatctgggtctttctagagcaccccagggtcgggggttctgttagctgggtagaggaccctctcctctgtgtgtcctgtggcgaggctgggtctgttctctcccgggtccaggaccacagactgtggtgacacaagtgccctgggcagagggcagccttctgcctttttagtactgggctccccagctgctctccccggcccggactcgtcagaagccacggtgactattgacacatctgcatcctctggcagaggcagatgggacatctctggcaaaatggtctattctgtgcttgaagtacagaacccagtgggaaactgctttatttttggagtccaacattctggaaatttctgttagaacccaccagcctcactggaaaattctgagtgctgatggtggttgactgagaagggataatgagtgttgttgcgaggtctccgatctcaagccgtaattaaccttgttgaactctgagcggtggtgtgtttccctggataccgccgggtgtgcttgttctatttcgttcctgcgtttttagagctttgcggttccctgtgtgtgcaccactgtgcgtgctcccgctctgtctttctaactcagccgggcctgggagagcaggaagctgttttgtctgtcttgattcttgctgccaggtgatacttctcggtgtgcaggaggcccttgtccatcatctgaacttggctgattggcattcagcttgagtgtgcttgagaccaaccgaggagagttgggttctgtgggtcagcagagggtccccgggctgtgtgttctggaggcctcagatagttgcacagccaggcctgaggccgtgttttcagaaatcccggctctttcgctgtcaagtggccccacccttttttttttttttcttttttctttttccagctgtgggcatggattggctggggcagggtggccaacccaggcggccacgcaggggtgctcagaggcgccagcttgaccaccttaacctctttgtctttctcccctgcagcacatggacggcagcttctctgtgaagcctttaaagcagaagcaaattgtaagtcatcagaggaaatatgacgtgcttgaattaaaagacacacatatacaatcactcacacgcatactcatacatagacacacactcatacacacgcacatatactcatacacgctcatacacactcatacacattcacttgcacatatatacggacacacatacataccatcagacactcacattcacacatatatagacacataaacacacagacacacacatacacacataaacacactcctactcgcacacactcatacagacacgacactcatacacacatacactcacactcacatgcagtcattcagatgcacacactcagacacactcatatactcagtcacacacatatacatagacacactcgtacacatacacacatacactcacactcactcacatatacatagacacatactgatacacacacatatacccattcacacacacatagacattcatacacatatacacatacacacacgtatacagacacacactcatacacatacccacacatatactcacacacataaactcacatgtatactcatacacatatacatagacacacattcactcgcacacatatacagacatacatacacacaatcacttgcacacatatacatagacacactcatacaatcactcacgcacatatacaaagacgcatacactcacatagacacacacacatacacatatgtacagacacacatatactcacacacacttatatatagacacacacacacactcttcagtagtcttcatgcactggtcttcctaggctacccttgctgctgcctttgaaataactgtgcaggggctgggcgcagtggctaacgcctgtaatcccagcacttcgggaggccgaggtgggcagatcacttgagcccaggagtttgatatcagcttggccaacatggtgagaccccgtctctactaaaaataaaaaaattaaccgggtataataacacatgcctgtaatctcagcaactcaggaggatgaggtaggagaatggcttgaacccaggaggtggaggttgcagtgagccgagatcatgccactgcactccagcctgggtgacagaggaagactgtgtcaaaaaaaaaaaaaaaaagctgtgcaacagcctgttgacttccctgtagagctctaagctctgggacgacgggtccctgtcttgggtgagcatatatgttttgcgtgcccgccatgtacagggacgcctgcaggccctgagttctgtccagtttgagccattgtgtctggaacatagtgttaagtaaatatttgccgaatggatggatggaaaaggaaggaaagagaccagaaacaaagtctgcaactccttctcctcttccttacaaattgtccaatatgtcagtattggacagagacttagcttgacttcatcaatacttgaaaagaaggattaaatagttgagaataaatggagctatagagcagtacatctgttctctggggtcagcgatcctgggatgctgcattgggaagtgttattcctggtggcctcacaagtaggcaccgagaatttagaggatggggtgccctaaacagcagtgttagatcttgctaatgagatgtcctaggccacagctaacagttactccgtgtgtactgttggggcgcataagacctgtttcaagccaccacttgggaatgatttttgttagtttttaattttttaaatatttaatttaattttaattttaattttattttattgagacaagacagagtctcgctctgttgcccaggctggaatgcagtggcgcgatctcagctcacttcaacctctgtctcccaggttcaagtgatttctcgttcaggctcccaagtagctgggactgcaggtgtgcgccaccacagttggttaatttgttttgttttattttgttttgtatttttgagatggagtctcactctgtcgccgaggctggagtgcagtggcatgatcccagcttactgtagcctccacctcctgggttcaagtgattcttctgcctcagcatcccgagtagctgggactacaggcacgcgccaccatgcctggctaatttttgtattttttgtagagatgaggttttgccatgttggccaagctggtctcaaacttttgggctcaagtgatccaccagcctcggcctcctactaaagtgctgggatgataggtgtaagccactgcacccggccatctgttagctttttagaagagagtttgtccaggtgcagtggcttatgcctatgatcccagcactatgggaggtggaggcaggaggattgcttgagcctggggattccagaccagcctgggcaatgtagcgagatcctgtctatttaaaatgtaaatcacaataaacaaaagagaggtgcagcaaactctagcaggtccaggtccctgcaggtaccaggggaacaggagaccccagtgatggtcagggccttgtgttgagagagctgaccagcaggccctgggctccctggagtggtgctcctggcccatggtctctgggaaacccagcagcacaaaccgctttgcaatgtggtcagcgtgaggctttttggttgcaagtgggtggcaggacagaatcagcttggagacattgctttggcgtctttgaaaccagagaggcttcatgccttttggaaggaggatctggaaagcagtgggaacttaggctgctgtctggtgccttcaggcgtcagctcctgctttcctcgtggggctggtggtggtggagccaagtggtgttgggggtggtgaggcggtcagggggtggtggttgggcctgtgggttggcttcaggcccccagtagtggggagagccaccggctccagccctgttccaggtgctgctggttgggtgggggcaagcagcaggttttccctgcccttctcctggcccccaggggttgagctggactgacccctggtatggaagcctggtaagttggaggcagggctaggccaggtgggtatggaggagccctcatatggcagttggcgagggcccagtgagcccctctctgctctccaggtggaccgggtcagctacctcctgcaggagatctatggcattgagaacaagaacaaccaggagaccaaggtgtgtatctgggtgaggtttccctctgccattacagaagcccacaccaggagcagccgcggacagcaatgcttgccggttcccttccatgccttcccctggagtcctagacccgctagacaacatcatttttccttaattttttttaaagctaacagtttagggaacattttatcctttctccagcaaattcactagcttctgatgtaaattgccatccaggttccccagggcagcccaggaatgggggccagtgtctcaccctctaggctcaggtgtgtggcaccctgctgcccggctcctgcccgcctccccagagacagcacgtccctgcagctcctgggggagggatgcttattctgtatgtccatagaaccagtcctggtgcctgacaaataagccgtggtgtaccccagtcagggaatgtagcaggggatgaaattagttttttttgtttttgttttttgagtcagtctcactctgctgctcaggctgtaatgcagcagggagatcttggctcactgtggcctccgcctcccgggttcaagcgattctcctgcctcagcctcctgagtagctgggaccacaggcacgcgccaccacacccggctaattttttgtattttagtagcgacggggtttcaccatgttggccaggatggtcttgatctcctgaccttgtgatccaccctcctcggcctcccaaagtgctgggattacaggcgtgaaccaccgcgcccagcctaatttttaatttttgtatttttagtagagatggggtttcactatgttggccaggctggtctcaaacttctgatctcaagtgatctgcctgcctcagcctcccaaagtgctgggatttcaggcctgagaccaccacgcctggtcgatgaacttgttaaaaggcacactgacatgagtgaaactcctgcctcttaagatctcttggaaagtctcacaggcccgcttcattatggcatctgggcccaggacaactggagcagctccacgtggcgggagcggagcacctggccgggcctcgcctcaacccagggaagtcagtgcattcatgtttcataccagggggcggcccactttgagaaaaggttcagagagggaatgttttcagccgcccgggcatatggtctctgttgcactgactccacgctgccattacaacaggagcagcggggactgtataaaaatgagtgggtgtggcggtgttccagtaagattttatttatagaaacaggccacaggcctagtttgtggacacctgttttagatttttggctttctttttgtccagttgctaatgtggtttctggtagctgccattaatgaaaatacttctaacatattaacttgttttttgttttttttgtttgtttgttttgagatggagtcttgctctgttgcccaggctggagtgcagtggcagccatcttggcccactgcaagctccgcctcctgggttcacgccattctcctgcctcagcctcctgagtagctggaactacaagcacgtgccaccatgcccggctaattttttgtatttttagtagagacggggtttcactatgttagccaggatggtctcgatctcctgacctcgtgatctgcccgcctcagcctcccaaagtgctgggattacaggcgtgagccaccgcgcctgaccattaacttggttttttttaaaccaaagataacgggtaccctgaccctcaggaagatgtgtttcttaggtgcatctgttcctcattttttctttaggtctgaagaacagaaagagaccatgttctcatgatttgggtgggtgaggggcacagaccctccccctctgccaggtgctgagtttgcactggatttgagcctggtgattctgctctggggcaacctccccctcccctctggacttctctttgtcatgacagcccccagggtagggtggagtggggtgggacagctggggacaggaagcaggagccgtactctggcctttgggaggctgctgacccacaagcccttgtcccggcagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcgtgagttccccggccggctgttctgtggaaggttctggaaattagggactggccacaccacggtggtcctgggatagggggccacaggtccgttgatggctaagaaagaagagttgtcattcatctagtctgtgctgaacgtgggcgtgttggctgtcggagtcagtcaccgtgagagagctggcagggacgctagcacggggcattcagatcttcacgtctgcctccagccaggcaaggcttgcagaacaaagggctacagaggcgctccagggcagatgaactgaacgaaaattgatgagtgaatgaaatctttattcttattttatttttattattttttgtttgagacagtttcgtgctgtcgcccaggctggagttcagtagcgagttctcagcttactgtaacctctgcctcctgagttcaagcaattctcctgtctcagcctccctagtagctgggattgcaggcaactgccaccatggccagctaatattttacttttattagagatggggttttgccatgttggccaggctggtcttgaactcctggcctcaagtaatctgcctgcctcagcctctcaaagtgctggtgttacaggcatgagccaccatgcctggctattttattttattttatttttttgagatagagtctcgctctgtcacccaggctggagtgcagtgttgcagtctcggctcactgcaaactccgcctcccgggtttaagtgattctcctgcctcagcctcctgagtagatgggattacagccctgcaccaccatgcctggctaatttttgtgttttaagtggagatggggtttcaccatgttggtcaggctggtctggaactcctgacctcgtgatctgccctcctgggcctcccaaagtgctggaattacaagcgtgagccaccgcttttttttttttcttttcttttctttttttttcttttcttttcttttctttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccgagccaccgctttttaattaattacttacttttatttatttatttattttgagacagagtcttaactctgttgcctaggctggagtacagtggcaggatcttggctcactgtaacctctgcctcccaggttcaaatgattcttgtgactcagcctcctgagttgctgggattacaggcatgtgccaccatgcccggctattttgtgtatttttagtagagatggggttttacattgttgcccagtctggtctgaagctcctgacctcaagtgatctgcctgccttggcctcccaaagtgctgggattacaggcagagccacagggccctgccttgtttttaaaattttttttgtagagacagggtcttgctatgttgcccagcctggtctcgaactcttggggttaagtggtcctcgtgcctcctaaagtgttgggattatgggcatgagccaccatggccagctcagatctttattttaaaggtaaaatagaaaatatttcaataaatttttagcataacgctggttgcagatcacacctataatcccagcactttgggaggtcaaggcaggaggatcgcttgagcccaagagttcgagactagcctgggcaacatggcgaaaccccatctgtacaaaaagttaaaagttagccagatgtgttggctatagtaccagtgacttggaaggctgaggcgggaggatcggctgagcctgggaggttgagggtgcagtgagctgtgattgtgccaccactgcacccccgcctgagagacaggggaagaccctgtttcaaaaaaaaaaaaaaaaattatagcgaagtgaaaacaaagtatgctgggtagaaaattgaccaaggaattaaattgggttttctagagcattccagacatttcctcagtgaaaagccgctcgtagggccccgttctgagtgtcttccagtagagggaacaacctgaatgttctcagggtgaaaaaacgaccaggtcaaagtgcacatcccactggtaggcccttgccctggatcctgggatccctggcctgggtcctggcggtggggccggagcatagttggggatttgcctgcgcagctgcaggacacatgcgcttagtaggccagcagacctccaagccgggcgtggggctgtgcgaggatgctggtctgtgcagtcaggccatggggtcactggatgtgtccagatcccaggagtaagtgaagaggctgctggggcctggagggagaggccggccgcccagcctgtggcagatcctgtagcagggagggccggcccaggctgtctgtcggcctctcctgtctgaaagccacagagttgcgggggcagggaccaggaagtgggggcaggggtgggctgtctaggaaggttctctgtgcctgcccaggaggcaggcagtgttgaggactgagcctcagggtggctgtgtggctggagatacagcagggctgctttccagggagggtgccctgaaccgagtccaattctggaatcttcaggtgtgtggggtcagtgggtcggggccatcagactggagttcagagctcccgtgtggctttgagcctcaaggacgtggcggtagaggggcccctcacaggcgcccgagggcagagactgctgttctcagtagaaattgacacagaggaggcctgaggccctgtccctgggctgacggcagatgcattggtttgttggaggtggctggtttggtggtttggtggttcggtttcctggcctgcacacgtcactaaaggtgtctcaggaacattctacagcagcctgtggggcccttgtgtgagcaggactggcactgtgggatgacagggcatcctaggtcctggtttatcttctctgctcccagtggctgctgtctgtgcccctcagcttccccagcgtgatgtttttgcctcagtttccccagcgtgactccccacttcagcttcctcagcatgatgtccttgtctcagtttccacagcatgacatccccacctcagcttccccagtgtgatgtccccgcctgccatcctgtcctgcagccaagagctcctctgggctcagccaggactgctgatttgcagtcacgtcctgtctcgggtgcagcctggagcttcaggggtgtgacgctttgggggtcatggccaccagcctcttggaaacaccctctggagccccgccttgggcagcactgcatggccttgctgtgtttcctgcccggggccatttcattaatactgtgtttgcgggagttctgtctctcgtctttggagcgccccctccctctatttctgtacaggggagctgcttctttctttcttcccccatctttcctgcctattaaattcctgctccttaaaactaaaagaaaaaaaaaagaccgttgtgatctggaagcggggtcaccccaggacccctatggtgtggggggggtgttgatccctggggctgggagggtcccctcggggctgggtgtgtcgcctgggcctgatctgagccctccttctgccgcagctttccgggccctcctgcagatccgggcggtgcggaagaagccaggagccctgtcccccgtgtccttcagccccgtcctggcccagagcctggagcatgatgagcactctgtaagtgccgcctcctgcctgcgggatgggcgggagaggggcatgagtgcctgggccaggcgcaaggcccagacggtccagccagcagccccgtgttctcttctgtccagtgggcaggcatggcccccatggatggctgtgaggcatgaagggggtggccaggctgggccctggggtgccgctgctgggaacagcgctgctgccatcagtaccagagcctgcgacaaggctgagcgcggtcgaggtctcggtggagccaggtgcttttttttttttttttttctttttgaggcagggtctcggtctgtcaccgaggctggtgtgcacccaaagtggtgcaatgtcagctcactgcagcctcgacctcccgcctcaagcaattcccccatttcagcctcccaagacgctgtgaccacgggcgtgtaccaccacgccgagctaatgttttgtatttttagtaaggtggggtttcccatgttgcccaggctggtctcgaactcttgggctcaagtgctagtcctgcctcagcctcccacagtgctgggattacaggcctgagccaccgcctccaccccgtggttcttagtgaatgagccatgctgtttcccccatgcgctgctgtgcaaggggcactggtgaccctcctcccacgctccaggcccaccaggcgccctcagtggggaccttaagggcaggccctgcttcagcaacacaagggaggtggaaccctggcttcaaggacccaaagacagacagagacatggagagagatgcacagagaaacacagagacagggcgagagagaggtggagagacacagggagaggcagagacaaatgtggagagacacagagacaggatgagagagatgtggagagacaaagggagagacagagaaagatgtggagagacatagggagagactgatggagagataggaagagacagacagatgtggagagacggagagacagatgtggagagacagggtgagagagatgtggagagacacagggagagacagagatggggatgggtggcaggggctgtggtgggcagggagcagaatgggggagttggacagtgactggttgggcccgggtcttaggccccctgctccccactggccacgcgcattgtcagattgagtgcctttcttggctcttagctgtggctgttatgagccgttggttcttccaggctctgctgcctctctaaacagaaaagaggagcagagccctgaggactggcgttcacagacagcgcctttgctctagaaggctcctcccaagcccccttgatcagggccttgacctgggccctatgggcctccctggcagcaggtgcaatgtttctgaaatggggtcaatgtttaaaagtctggaatttcccttaaaacccagattttgggtttgtcttttaaaatctgacatggtcttgatgctagaggagaaacatggcttgggggtccctgtcaacccaggccctctaggcccctaccatcgtggggctcctggcaccacgctctccagcacttttgatgttggctttgattcggaaacgctgcgtgtgctcaggtttttggtggagagagaagcagcccctgagggatttgcctctgagagggtttcacctagggagtgatcgatgctcaggcgtggctaggtttattgtcccttgtttttgcccctccctgtttgtgttctggtggctgaggatccagtaggtccctccatgtttgtccctcttatgctgagtgagctgggcggccggggtccgaggtgtgaccaggcagctctgacctccacatgccccagaagggctggcacccagccagggagccgccgtcctctctgcatggagcaaaagcaaacgctcctcctcacctgccaggttcctgttggagccccttccacgtagtgacagaaagagccaccgtgggtgttctctccagcgagtgcctaaagatgatggtggggtgggtgggtctggggctgactcttctccccagccctcttgaggggttcatggttggtgataagtgagcggcggtgcctgggcaccggctggctgggggactttgaccagtgtggcttcaggatctccaccctgcacccagcctgcattaggcagcgttcagctgccctcacgtccaccttggccaaatctgttgccccaggtgacccagactgcggggggacaggcaatggggatgagattgggctccacagcctccccactgcagcagcacagctcccgggagctgccgagacgcacacatggcccacccagacccgagtcaaccctcacttaggacagtcccgagattcacgtcccccggaagcttgtgaagttctgcgccacggtgtggcaagaggacagccagtcagacctgtccagcccactccagggccgcgtgggggtggtagttgtaaaacatatgatttttatcttgacagtgtccctttaaaaaatcaaagccgcaccccgcctccctggccagcaagaaacctaaaagggaaacagtaagtgtctggtcctccggctacgtttttttgcccccgccctcatttttaaacccacgacaagtaggggagatcgtttccgccccaggctagtgtctgattcatataacccgtcagctccacttgcccagtcccggcctccctgcccagggagtttgtggaaccggaaaagctctcggtccgtgggcgaaacgccaggtgcgctggccccgccgccctcccctcagctttgcctccgccccgcgtggcccccgtgccgtttcccttttttttcttgctggcagtggaatggacgttgcaggcggaactaacgtcgctgctgcgttttgcaatcgcgccccgcgcatgcttcttggccccgtgtcccgctcctttaccctgcgggttcgagctccttgggctgagctttttggtttccttgggcttcccttgtgccccagggagcaggcagggggaccagcacacaaccacctggagcctccgtggcccaggcagacccagccgaaaccctgtgtgcgttggtgtagaaggtggaggccactccggagccacccggaccgtgttttcctttctagaggggtgaggggattctgtgtggttatttacccttaacttggaggcaggtatgggagcaaatgtggggtacacagaggtccagaaaagcatcccgggctcattgcccgggccgtgcccgctcccccatttctcccccacctccccgtggtctccaggcatcccgcacccatctcactttccccttccttccaggagctcggtcaggcaggccggggtctcccgaaaggagcactgacgagcgttgtgcccctcaacctggttttgtggggacagagcaggggcccccgcagtctgacttccgttccccagaacctgggcattttccttcttcctcagccttgttgattctgtctgctcccagtgagggaagaacagtggctcttagccagggtgcccgttagaaccacctggagcaggtcagcccccagaggcccgggcagggcacagctcccaacagctcagctctccctggtccaggacgcccctgaccgtgtctctcgcctctggcatggctttgctctgcccccgctcccagctcctgtctgtcactaacccttcactctccacctggggccaggcgggactgaaagccagggaggggctggttgaggccagggctggggcggttcttggcagatgccctcgtgcccgtcatcccaggcaccagcgtgggcatttgggcatccagccccgtgctggagctgatggctgaggcagggagggcatcggtgctgccagggagctcttggccaccctctgagggtgggggagtctcaatcccccaaagaacagagtggacaggaggtcatcaggaggagcgtctggggagcaggtggtccctgggcatgagccccctcacgcaccctgtccctacagaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacaggtgagcagcagccaggccaggtgcatggcagggtgtgtggtggcgcgcgtgcggagcgggtgtctttgtggtttcaaatcagtttgtgatgtgttctgtgtggcgattccccagaaggactcggagaccccgtatcaggttagactcatgggtaaagtttattacggcaaagaacgcagcagacgaggcaggaagagcgtccgggcagctggaggctttgatcccccgaccagggccacaccggcgtgcaggcgcatacgtgctctcgagcaggaaactgcaggggtcggtgctgtgtctctgctgaggggagcccctttgagcctctgggttcccagacttcattggggggctggccacgtaggcccactctgccggtgaccagccagggcagccgaaactcaggacctgacagtgacccaggcacactcactgctcttgccgttcgcccgtgacgagccacggggcacggtccctctccaggcgatgagtgcatcatccatcactcatacgacagccttcggagggcctggctcctggggttggccacgggtcattcgtggttcccctggagccttgcggtgtatagagcggcggctgccagggggactctgtgcctcaggcctgtcggttctcgtagaagagtgtcaggaaggcgcgggttctgcaggcccgccctgggcaccctccatgcccacgaggaggcagcgccaaagctcagagaaacgggggcctctgtctcctgctgcttctcctccccaggaaccaccagcggtttctcttctccttctagaaagaaaaggaaggctaggcccgtgccagtgtgtcgggagcccctctgtcgggcgggtctgtggtggccgctgttgcctgttggccgtttgggttggtcccggtggctggtgatgcccttctccagggagtgtccttgcgtgggtcctggcaggcgtgtgcaggggcccccaggtgccctgcatggctttggcagggttagccttccttgtcgttatcctctcacccctgcccaccctctcctctgtccccagcaccctacggtccccgtcttcccccatccacgaagaggatgaggagaagctctccgaggacgtggacgcccctcccccactgggtggcgcagagctggccctgcgggaaagcagctcccctgaggtgaggcccccccggggaagctttgcgcacccgcccgggccagccctcctccagcttctgtcgctggaatcagaccccatcccactgcccgcctgggcgcccccgtgcttgttggctcttgctgagctgcgcggctccttagcctcggtctgtggaggcagcaccccctggtggagcggctgtgcggtcccgggagggccgtgcctgatggcggcttgtcctggagcggtggccgcggctctctgagctctaggctactttcccctttgtttcctagagtttcataacagaagaggttgatgagtcgtcgtcaccacagcaaggtgagcgcctccttccatgggcacaaaccgcatgcagggaccaggcagccctggcttactggggccttagggctccaggtggtgttgggccagcacctcttctgccccaggaaccctcggccaagaggcccccctcggcggcactgggatcccggctgggagggactgaacgggtgactgggtcaggctgcgctgttgaccctgcagggctgtctgcctgggatggggaacacctgccagcattcagtcctggttttgaaacatgagcgtgtaatgtttctatgaccaaaaaaaaaaaagccctatgctctgaacatccaggacacagtgtaaaaaaggggaaaaaaaagccccatgctgggggatgggaaggagggaaatagaagggaaacacccagctttggggtccctggagagcaggtggggtcacggtggagtcctgctggagcacaagcctggggtccccacagtggctacagagcccttgggtaagagagacggcctcctgcccagagggacctgccgggacctggcccctgcctgtaggtccctaacctcaccctctgcctgcagggacccgagcagcttccattgagaatgtcctgcaggacagcagccccgagcactgtggccgaggcccacctgctgacatctacctgccaggtaaggggctgggggtctgggggtgaggggctgggtgcctgtcttagtccccagggagggggccctgctctgatggtcggtgcatagcagcagaggctgtccattggagcctggttctctccctggctctcagccatgcccctgctattgaccgtgaagcaggatgcgggccagggccatggccacaaagcagcctcaggcagggcctggctcttgggagcggaacctgcaccaaagccccttccctccctggggccacattggccacaggaggtgagagacgcgagagaggctgcctgtgagaggatggggtccttttccctctgcctgctgctcacgccaggagggcagatccggccccactgggatcaccacatgttcccccactcctggtcctatcgtgggcccacaggccccatgctgggtgccacgtgcgctcctggcagtgcctgagagctgcagacagagcaggagcaggtaccacacgctgtgctgggtagcgggggccctgggccacagagcgcaggggcagtgtcttctgggtcaccctgccccgggcctgacagaggccacctgatgcagcagcacatcccaggccaggcacagaggacggcgggggcgccaggcgccagcggggaacagcaaggcagcaaggctgggacagagggttgctcttctcacctttcccggaggctcgggccccagaccccatcagccaagcaccttcgtgctctgctctgctgggataagatcctcagtttcgaatcctaagctctaaagaccgggagggaatgggggctctcagactagtgtctcagcacctgccacgaggctgtctgcggctctggaactgcgataaacagccacggtgctttcagacatgaccccagagccactgcttagggagtgtggctcttccctcgcggctgccaggcttcacccgcttcctggccccagggcccaccattgctcaatcctcctgagtcacctggtgacctgggcctgacattgggtggttgtgacgtgctttagttggaaaggggctcttgtgcccccggactctggctgagcagtggcctgtgctcatgggctgggcgtgacaggtcgcaggtgcaggagcaggcactgcctctggtgccctgatgaccacagcggcctgccccgaacaactcacagcagaaggtgtgtttaggaccagcttaccttaaagtgacacagaattcgagtaaggtctttcagaggatctcaaatatttcattctgattaaaaacttggggggtgatcggggaagaggccagaaggacctcagcttctgggagccacgaacatgatatctgatcctgcagggtggccctgtgggggagcatctcagaggctgcgcctcccctctgtggccaggcctgggaaggattgggacagctacagaggaggcccacacagaggaggccaggactccgagtctcatgccccacccacaggggagggtctcgggccttcttcaggcccacagacgggggcaggcagtcgtcatctgtggaggcggtagaggagaggccgagtctacatcggggcagcctgaggtgaactcctgggccctgggccccgctcttggagttggctgctgctgaatgccagcaggtcagcctgcacggcctcagttctgagccacggagagcacatgtgcctttgggggctgtttggcgccatctccgtggctgtcagccttgtcagcacaggtttctgtgtgtttttaaatccatgtggtggcccctctgttccactgactttttcacatcacagagcccttgactgtctatccgtgtctgtgcgtaaggcatgaacacacgccagagcctttggtttctcataggggtgcagccgctgcctggcggggtgggcggcatcactgaaccctgctgtccctgtagatgggagggcccatgagatggtgaacactgggggccctggtgtcttggacttggccctgagctcggtcctgtctagcctcagccccccacccagggccttcactcctgaaaccagaggtggactgcgcccgttaggtccttcatgcgcccttccctaggctgcggcagcgggaggtatgggagggaggggcagggccagtgcgctcctccgcgttgaattctggctgcgctctgcctcccagctgtggttctccttgtggttctctgtggttgcagcagagtgtttgtttctagacggcctcgaccgtgtccccaagctggtgcccttgctgtggctgtgctggctgctgcgcgcttgctaaccgagcttccgtctgtctctccccctctccgcgcagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaata

SEQ ID NO: 1355 - DNA, 66150 bp, Homo sapiens; identical to SEQ ID NO: 1354

SEQ ID NO: 1356 - DNA, 66150 bp, Homo sapiens; identical to SEQ ID NO: 1354

SEQ ID NO: 1357 - DNA, 66150 bp, Homo sapiens; identical to SEQ ID NO: 1354

SEQ ID NO: 1358 - DNA, 214025 bp, Homo sapiens
ttagattagtacaggtttacttttaaatatttaataatataaaagacttgcatagcttcaattcatttaagcttcccaataatgggtaaattttaagtttcctgaaaagtgagatcatccatgtagacaatcctgtttttgacataattgtccaacgtggaggaggaaacttgttaaggccttccatttatcttaccatcagtgacagctgagtcgattttctcttctggtgggtatgctttgttccttttggaaaatgcctggctgatttctgcataggttctgtttttggtctcaggcagcacaaaatacaggtagatagcacctgtgatacaaattgtagcaaagactaggaaacagtaggtgtccagacttttctgtggaaaggcagagacaaaaaccctcaaatagataatcagtaaacttgctgttaaaccatctctacacagatttttaagatagctccacattcatataccaatactcctagacaaaacaccatgtgtgatgctggctcaataaggcaagtgtaccctacatgaagtgttatcacataaggcttgaataaatcagcttcaaactctgggaaagatgagaaaatggcacttttttgttgttgttgttgcaaatttggcatttaaaaattaatcatcacgaaagcaaaatggaatgcttgctgaatattagcttaagcttatatttacaattaaccacattgtcttcttgcttctactatacacatgagacaagaatgacatcaaaagggaagagaaatgccttagttcataggaagaatgtggagcacagaataggccaaggtaatgccagttttttctaatatgcaaatgatctaactcactaattgatactctgaggcggccttgcacaaataagagagatcagaaaaaatagaaatgctcaatgcaatcactccgttttatgtatcctgattagtgtttggactagaataaccctgccaactgcactagaccttgagcttctcagtgactcagtcacctctgtagctcctgtgccttataggaggtactcaggacatatttgtggaataaaagacttgaaatcctagcctcaatcaatctgcttgctttggtctcccaggtactgggattataggcatgagccaccattccagaaataaaagactttctgggtcccagctgtcaggattgtgactattatatgcaacaaacatctactgatccaaagataaggtgacactgtctttgaataatatttcccaagaagcaatatccagattttagtcaattccattctattctttgatttgacaaacatttatttttggagaatggcaaagtgcttaagcttgatccctggatcacatcctagatctaccatttactaaatctgagactctttgtccctcagtttccatgattgaaaaagaggataatcatggtacatgtagggttgttgtatgaattaaatgagacattccctttaaagtgccacatgcagtaaatgttccacacctgggggtgcttagctcttgagactgtgccttctgctcgtacaaagacttcaagagtagtgtggagaagggggagagtatgggctctgaagccagtcgagtgggattcaaatcctgatcccattactcacatgttgttctaacacttatgatgtgccatttaagatagaatttcaatccactgagcatctgtttcctcatttgcaacatggtgatatatacccacacattgttttgaagatgaaatgagatatatcaattttgcattcaacatcctccacacccccatctgcaggcggaatggacatctgacttatcaagtccaaagtggagcctctaaaactgcctgctctagccttcctcatctctgctgatggcacctccatccttctgattgattatgccaacaaaaacacttggaggcaggctgagcttctctctctctctcccacccacatctgctccatcaggaaatcatgttgctccaccttgaaatgtattccaaatctgagggtttgtcatcacttctattgtaacctaattttggtgcaagccaccatcatgttttgcttggatttttgcaatagcttgtcaactgatttccctgcttttcactttaagcataatcttaagattattcttaacagacaagccagagtgatcctgttaaacaaaggacaaaacttgtcactcctctgctcaaaacccaccatgacttcctaagtcacctgcaggaaagccaaagtcctcaccatggcctccaaggccaccgaccatgtgtccctcttatttctctgatcttactctcctcactttctttgccccaactccactgcctttatgatttccctccagtattaggcctcagaatctttgcacatgctgttctctcttgctggaataatcttcgtttaggcctctgtatatcctgctttcttactcctcttcatccgacttaaaggtcattttctcagagaggttctcgttgactctcattttgaaatagcccctcccagccctgcttcattgccttcaaaaacactcatcactatgcagcattatagtgtgcaactgcctgtttattaaccttctccctaccaagaggtaactatctgaaggcaggagtcatcatttttcttgtattcccagagcccggagagtctctgatatacagtagatgctctgagtatcttagtgagtggatggatggactgaggctcagagaggcttcctgccgtatcccaggccacaaacagggcttcctaggacctctctgacacccacacagctgcctcttgcttggctttcttttcccaagggacctgatgggtgtcgtgaggattattctcacagtttcacaaaattcagtcaagaacatgtggctcagccgagcacagtagctcacacctgtaatcccagcactttgggaggctgaggtgggtggatcacttgaggtcagaagttcaggaccagcccggccaacattgtgaaaccccatctctactaaaattacaaaaattagctaggcgtggtggcagtcgcctgttatcccagctacttgagagactgaggtaaagattaaaactggaccccctccttacaccttatacaaaaattaactcaagatgcttaaagacttaaatgtaaaacccaaaactataaaaaccctagaagaaaatctaggcaataccattcgggacatagtcacgggcaaagatttcatgacaaaaatgtcaaaaaaaaaaaaaaagaagagcaacaaaagcaaaaattgacgaatgggatctaattaaactaaagagcttctccactgcaaaagaaactatcatcatagtgaacatacaacctacacaatgagagaaagtttttgcaatctatccatctgacagaggtctaatatccagagttcataaggaacttaaacaaatttacaagaaaaaacaacctcattaaaaagtgggcaaaggacacacacagatgcttctcaaaagaagacattcatatggccaaaaaacatatgaaaaaaagctcaacatcactgatcattagagaaaggcaaatcaaaaccacaatgagataccatctcataccagtcaaaatggcgattattaaaaagtcaagaaacaacagatgctggcgagcttgcggagaaaaaggaatgcttctacattgttggtgggagtttaaattagttcaatcattgtgaaaaacagcatggtgattcctcaaagacctagagacagaaatgccatttgtctcagcaatcccattactgggtatctacccaaaggaatgtaaatcattgtattataaagatacatgcatgtgtatatttattgcagcactattcacaacagcaaagatatggaatcaacccaaatgtgcatcaacgatagactggataaagaaaatgtggcacatatacaccatggaatactatgtagccataaaaaggaatgagatcaagtcctttgcagtgacatggatggagctggaagctgttaccctcagaaaactaacacaggaacagaaaaccaaacactgcatgttctcacttataagtgggagctgaacaacgagaacacatggacacattgaggggaacaatactggggcctatcagggggttgtggtggagggagagtgttaggaagaatagctaatggactctgggtttaatattaatacctaggtgattggttgatctgtgtagcaaaccaccacggcatgtgtttacttgtgtaacaaacctgcacatcctgcacatgtaccccaaacttagaataaaagttgaagaaaaacaaaaagctcagaaaaagtttgactagtcctgcccgtctcactctgcttaggcactcaggatatgacccaatattcttcaggttgaaaagaataatttgctcttttccagaatttattgagctcaaactgcattttataacttgagtagaatcaaagaggcatacatttgcatgcaattttctctgaatcggaaaatattggcactccacactggagagtgtttttcgcaggctttataacaaatggcccaagcaacactgatgctgaccacagcaaatgctgccaacaggatcccagagccagagtgtggaggtgagcatgaagggatgtgggctcctccccacaaccacagttgcctcccttctctgttggtgatgagaaggctaaggattttccctgttttacaggtgaggaaacccaggcttggagaggaaacccatgcttgaggagcatgctcagggccctccgctaatacatgggcttcaatacaggcgtgattcgtgccgttgtctgtggctctactggctcagacattttattctgaggaagaagcccaggcttcttaggggtctgtttgggggctggaatacatttgccactgatacttattggaataagtgaaacaatcaagttgtgtgagtagtttctcttggtggctgctgtgggctgaactgcgtccctcctgaaattcatacgttgagtcctaagccctagcacctcaggatgtgattaagttgaaatgaggtcattagggtggggccctaatccaatatcctgctattctcataagagaggagaagaggacacagatcaacacagaagggagaccatgcgaggacacagggagaagacagctgcaaggaacatggttgtgctttggtcaagggtaggctgaggtaaacatccagagtgactcagtgagtttagagggcaggtgtataactctacttgttatcacagccatgtagccataacatgggaagggcatcccttggccctacaccactgttgtctgtaaaaggtataactgccctgctgacactgtacatgcactcttgcgctgccgcccagagaaagagagagaaaaccagagctgtccatctgcaaaatggaaagaggggagccaggacatagcttgagttctggtgcccagagaaagagttaagctgctgaccttgaagggcaagctggcagtgcagccatgtgtgggagctgctggactaagcagccaagacagggtggacagtgtgagagaactagtgtgagtgagcttctcatgagagactacattgcacctgcctacggccccctgagtgttcttccagctgtctgctcatccacccactcccttcggacctcagcatgagctggaacctgaccctggggataacaattggtgtagttgtgaacttgacaacagccattaacaagccaaggagaggggcctcagaagaaatcaaccgtgctaagcccttgagctcagacttctaccttctagaattgtgagacaataaatttctgttgttgaagctccctagtctgtgctatttggtcatggcggcccgaggcccgagtagatgaacacagtagctcttgattgtggctgagctggttttcagaagggaggtaggtcagaaatggttcacgtatggcatctagaacacatacacgttgctcccatgggcgggcgtgagtggggctgtggtgggctggggttgggggatgtgactcagaacttgttagccctgtatttctctaatgcattgatcattgctcacagcagccccctgagcccagctctctaacttgctaagctcctctccggaaaggaaattaaccgtgggtgccttcccaggcttgggtcaggaggctgacatttcacaaaatactaaacgtatctacctgcccagtgtctccatctgtatgtccagcctggctgttcctgctccgatgaaggttcatcaatagtcacacctgcaatgtttcccgaatgacccctgaaaacccagacaccctggacatacccagcttctcaggaactgtttccagaggggatttgtttcgaaaatgcccacaggcataagaaaaggctcataaatgacaggcaagagaagcaagaacaaaacaaagaattgattccagtttttagaaatacaaaaaattatctaggtttggaagtgcagtgaccttggaagttactacatctctctgagctcatccccttgcctgtcaaagggagtgatacaggcactacctcctagcacaggcagcggtggagcactctgggcacacagcaagcattcagtgaacactatactaaagtggcatgttggtgctgttaatgctcaaactgtggcaggcaagcaaggtctttcacaccccacacccctgagtggctcagaagatagtggcctgcttctcggacatacaaatctcagtactgggccatgtgaaggtgctggaacttctctacttaatttataaatgtgatgggggaaccatgttgacagaagcagcttgaagttaacttttgccacaataatgaggattttactgacacctggctctgctggctttgagccaaactgtaaaaagccacttaaggtttaaagtcaattgaaaagatacttgttatgttctgactgcagccacgtgaaggtgtcccaggatgggaataaatgagtgtgggatcttgactaactccatggctcatggagcccccagcagcccttacgtttcagaaatagagtgtttgttgctaaaacacaaagatgtcttgaaagttacagggtgtggcagccttctaactctgagacgaggaggctgtagcaagtgatggatggagagggaagttgagcacaaggtggtgaagtggagaaactgggtttgatgctgactgtgggacctgggctgaccatgtctgcttcctggacctccttgcctgtacagtggcaaggatcagaaactccagctcaggactgtgtgagggtgatgtgggcacagaaagccatgcatgggggagggtgcggcacagagcaactgctccgtaactgtgaatgcaggaacagccaccatgctggggtggctggggcttggagtgccgcaaatactgacctttggctcacccaagctggcagcagaatctctgggatgtgttgggcttggcactagtaaattagcaggcggacttagaactgagtgtccagaatagttggtgaggggaggaagacaggaagacaggattgaaatagctcctgagaatgggtggtgatgtatatgacggattctcacctcctccaggtggtaccacccagcactgagggcagcagggagccctggtgggcatttgagcagggaagcttcatcctccttctgcaaatgcttctgggccccttgctctgtgcagaaggcttgcaaagccttttgtgttcctgctcccagataaccctcttatctgatcctctctctcacccatctttcttgctcactctgtttcagtcatataggcctctgggtggtttcttacacaggccaaatattagccctgcctaagggcccttgcacttgctgtttttctagccaggacttcaccattcccagacagctctgctccctcacttcactcaggcctctgcgcaacggtcacctccttccagagcccttcacgattgccccatttaaaatagcacttatgcctcttttgtttccccgttcagctccagaaccaggaaacacaggctttgttaccactgtatcctcattgcctagaaaagtgcctggcacacagctgggactcaacatatatatgtgttgaattaatgaattcggtttccaatgaacagatcctttccctacccaaaaagacttgtatctgattcttgagtatgtgggcattttcctactgatcactgtcacccttgggacaatgatcccattagctgtggttatgatgatgacaatgaggatgttaaatgggtggtggtttgcagtgtgcactggaactattagatggaatttgtcttacacagtgatgagcacattgtaaaaatgataagtaggttgtaggtttgagttgctaacctaggagtccttgcataccgtcagcaatgggtagcccacaccctctgaaagagcccacagcatttagggaagctctaggaaggcacaggaaagagaaagggatgaaaggttttgcccaaagcatagtttcttccttccttaggaaaatagcatgagtttccagttgagaggagagagatcaacttctgctctatgaatcacccctcaagtgctgcagaatcaaagggaaccccatgggcaaaagactccttgtcagtcatacctgaatgaatgggaagaggagcccaacagcaaagttggagagccagttgacggtgcctgcaatgatgaaggcagccggccgctgagattgctggaagaactcaccagtcaagatgaacgggatgccacctgcagtgtgtgagccaggacatggaattaatcactctgagaaggtcatgcctccagcatccatctccatctgccacactttagaacccccccacccctgccccttgactggatgtgtagtgggccccagttcctgagtcgccctggtggcattgcagtgggacaagtctttattttgagagactgtcctgtgcaattgcagggcatttattaccctttactttctgatgccaggagagcctccagtcaccaccacaacccaagccaaccctacacatttccaaactcacatgtggtctcaggtctatacccttcctttcctccatatcctgtacagtgagaccagtgatcacgccctgtgcccagaccaggacctagggctcagcatgactgctgggatcccacttgaacctccccatctccagctggagtcaccactctgccaatgagatctacacctgggtgtttctcagacaagacagagtgggtaatggatgggaaatccctcagggacttttactaaactctagagagacagtgaacacaatttggaaattactaggctggaggcattcattgtgtcaacatccaacaattatttatgtgctggggctgttccaacagtgaggtcaaaagcaacatgtccttgctttcatgcggaacccttgtctgctgggatgacttgttcattaaaatgggagtgagtccaggaatggaaaaccaaacatcgtatgttgtcactcaaaagtgagagctaagctacgaggatgcaaaggcataagaatgatacaactggggccaggcgcggtggctcacacctgtaatcccagcactttgggaggcagaggccagtggattacatgaggtcaggagtttgagaccagcctgactaacatggtgaaaccccatctctactaaaaatacaaaaattagctgggcgtggtggtgcatgcttgttatcccggctactcgagaggctgaggcaggagaatcatttgaacctggaaggtggaggttgcagtgagccgagatcaagcatattgcacaccagcctgggcaacaagagtgaaactccctctcaaaaaaaaaaaaaaaaaaaaaaagataaaagaatgatacaacagactttgggaactcgggggaaagggtgggaggggggtgagttataaaacactacaaattgggtgaatgtatactgcttgggtgatgggtgcatcaaaatctcggaaatcaccaccaaaaaacttattcatgtaaccaaacaccacctgttccccaaaaaacctatggaaataaaaaaataaaaataaaaaaggggagtgagcaaatgaataaatacatataaatacaaaatgtgataagcattctggaggagatgcactgtctattttggcagtgggtggagaaggatgctctggggaggagatggtggagatgtggattgaagacgggaaggtggctcctgaagatctggggaagatcatgccgagtggagggaggggccagcagaggtcctacaggtgaaaggattgggccaaagtctacaacaggggccaatctgtccagacacctgaaggaggcagagaggaatggggtgaggtagcaaatgtgagcagggccaatgaagcagcctcttgtagatcatggagaggggtttgcagttgaagaaaaccactttgggctgctatgcagcagttgaggtgatcaatttgcatttcacagaggtcactgctctttggagaaaagcctggagggtgtaggagaggatgcagcaggctgttggggcagtccagggaggaggcaatggttgtttaggggggctcagatcacggcaggtgagatgaaaggaagggtctgaatttggagacaattgctccattgaggtaaagctttcaaggtaagcattgcacatacacaatcacttagcaagccgacccaaccaagcagcccagggtgacaaagccacaaagccaaggccaactcaagtctgaatctctccagacctttcaccgttatcaccccactatgatgccagcaaggcttgcactccaacaaatcaaaaacaactcggaatggagcgtcccctcacctcccactacactgtgagcccctctgatcaggcactatctccatttgtctggcatttcccacagagtagatactccatcaatatttacttacataagttaaatgctcaaaagttgattttgacaagatttgatatgctgttcactacaaaaatattagactctatatcttaaaggtatctattgaactgtgtgagaataatggttacacactgaaatgtaatgaaaccagcctttggttctgcaaaatatttcattgtcagaaagtgtttgtgtcacacactcagttggtcctgcagctaacaccactgggaatcagttcacagcaattctgaagcctgaacagggttaggtgatgatgtttcactttctgtgtctttcctaggtgtgtttttggaagcacctgtggataactcagtacttctgaggctggtacaatggaatgcggtacatcaatgtacaatgcagtagaacactgacaaattgcctcctggtacatctctttgtttcttcagggcttgaggccatgacttgtttattggttaagactcctgatcctagcacagtgctgaacacataccaggtgctctgtaagtgtttgcaggattgatgaaagaacaaataattaggatgccagggaattcatggtacattgatatcagatcctctctttcactaggccttcagaccaagccctaagcaaccatgaggagcctgcacagctccactgtacacaggtgtgttcactcccattatctcccttgatcttcccaaccagagaaggtggtaaagcatagtggactggagcttgggctttggtgttagtaagatcaggtttaagtcctatctcagctaaatctttctagaacggaattctctcacctgtaaagtgagtaggagcttgctactggggatatttgtgagcatgaaatgaactactaaatgcaaacacttaatataagtcttgtacatgaagggcactcaataggtgttagatactataataataataatcaagactcctctccattatatcccccattttatgatgagttagctgaagctaagagaaggggagtaatatatgcaaggtttcttagcaagaagtgatggtgatgaagaagatgatgatggtaatgatgatgacgatggtgcttctgtagctgctggtgaagatgatgatggtaactgtggcaggcattatgaaaagcattttacaaggtctctacaaggagaactacaaaccactgcttaaagaaatcatagatggcacaaacaaatggaaaaacattccatgctcattgataaaaagaactaatattgttaaaattgcccacagcaatttatgaattcaatgttattcccattaaactaccattgacattcttcacagagccataaaaaaccgttttaaaattcatgtggaaccaaaaaagagactgaatagccaaggcaatgctaagcaaaaagaacaaagctgggggcatcatactacctgacttaaaacaatactacagaattatagtaaccaaaacagcatggtactggtacaagaacacatatatagaccaatggaacaaaatagagaacccagaaataagactgtgcacctacaactatctgatctttgacacacctgacaaaaacaagcaatggggaaaggactgtattcaataaatgttgttgggataaatggctagccatttgcagaagattgaaactggactcctcccttacaccatatacaaaaatacactcaagatggattaaatacttaaatgtaaaacccaaaactatagaaaccctggaagacaacctaggcaataccattcggcaaataggcacaggcaaagatttcatgacgagaacaccaaaagcaattgcaacaaaagcaaaaattgacaaatgggatccaattaaactaaagagcttttgcacaacaaaagaaactatcaacagagtaaacagacaacctatagaatgggagaaatttttgcaaactatgcatctgacaaagatccagcatctatatgaaacttaaacaaatttacaagaataaaacccattaaaaagcaggcaaaggacatgaacacttttcaaaagaagacatacatgtggttaaaaatcatatgaagaaaagctcaatatcactgatcattagagaaatgtaaatcaaaaccacaatgagataccatctcacaacagtcataatgcctattactaaaaactaaaaaaataacagatactggctgggttgtggagaaaaaggaacatttatacactgttcgtgggagtgtaaattagttcaaccattatggaagacagtgtggccgttcctcaaagacctaaagacagaactactattcgacccagcaatctcattaccaggtatatacccaaaggaatacaaatacaaagatacatgcatgtgtatgttcattgcagcattattcacaataggaaagacatggaatcatcctagatgcccatcaatgatagactggataaagaaaatgtggtatatatacactatggaatactatgcagccataaaaaaagaatgagatcatgtcctttgcagggacatggatggaactggaggccattatcctagcaaactaaatgcaggaacagaaaaccaaatattacattttctcacttataaatgggagctaaatgatgagaacaaatggacacatagagcggaacaacacacactggggcttactggagggtgggaaaacagagaggatcaggaaaaatattaataacaaataggtactaggcttggtacctgggtgatgaaataatctgcataacaaacccttatgaaacacatttacctatgtaacaaacctgcacatgtaccccgaacttaaaaataaaagtttaaaaaagcactttacatatattatcttatttaattatcactatgatatgatagttactgctattatttttccatttactatacaaagaaacttaggcttgtggaaggtaagtaattttttcaagagcacatcaccagtaagctgcaaactcagtgactctgggtaactccacagcatgagttttaactactcccttgggccccaagcaagtctaagatactaacaaaacttaaaatacttgaaaagaacttagctatcttcatagttttatctgaatgctctcccaaaccctgcaattcatttatctctcttactgaaggccttggtggcctgatttcctaagagtcttttaaggtctctttcttccaatccaaggtaaaatgagaaagaatggggtttgataaagaaacagaatgcatttcaggcaggccttcttttatttttattttgtttttaagaatgaaaatagttttattgtttttttctgactttcatgaataatatttgctcatgtaaaataattttttaaagcatgcaacatgacaaagtataaaaaggaaacaaaaattacctctaagccttccacctagagatgatctccatttgtattttggtatttagctttgatgttaaatgttctgtgaagaagattggggctacttgggatatttgtcttttaggtgtttgcctttttctacctagaaccctgaggaaattgttctttatctttgaaattcattaactatgatgtttttggttgtattagtccatttttgcactgctataaagatatacctgacactgagtaatttataaagaataaagatttaattgactcagagttccaaatggctgcggaggcctcaggaaacttacaatcgtggaggaaggcaaaggggaagcaagacacgtcttaccatatcaaaagaggacaaagagagaaagcaggggaaacttccactttgaaaccattagatcttgtgagaactccctctctatcacaagaacagcatgggggaactactcccatgattcaatcacctcctacaagtccctcccctgacatgtggggattacaattcgagatgagatttgggtagggacacagaaccaaatcatattctggtgttgattttcctatagcaactttttgtagaacatagcatatccctttgagctgcagatccactcttcatttacttcttatgttatacctttgaaaatgtcttattttctacatgttggattctttgctttagagacacccattatccttgtgttggatcagctttgtttccctttcctattggccatctcgtgagcgactttgttctcttgttttctgcatagatattgtatgctctgggaaatctctctcttccttcttctctccctttctttcctttcttctttgttctagtttcccaggttggctctttccctgtgcattgtcctccatttctcttatccttattgcagtgagctactttgtccagattgccacctgctgtgatatgatggaagaccgatctttgacaccttttctttttatcttctagtttatcttggctttcacatcacagtttgagatctgagtactaactttcagtaagttttcaataaattatgggaaaatgtggcaggggtggggtgggtagaaaaattggttaggggtgtcagcagccctttatggaggatctgggttcttctctctctcttcttagattttgtaaagtgacatgcaccggaacccattccatgttgtcaggggcatattctactccagtggcctttaactggtttcctcaaattaggacatagtcttaggaagtggcaatccccaggaccctttgagagggctgtttggggggaaggtatcttcttgatctttctctgcaattgctgactcacctgctcactctgtctcccccataaaatcaaggtggtagcaagagttcttagggttcataaaatctccttctctggtcagtgctgttttctaaagagtggagacagaatctcctatgctagaattatcctttattggctgctagttttctaggtatgtgatatatttccttgtttggttactgctggccattttttttcaatctgtgtaaaggtttgctttgttggtattgttattgattttaacgactcttttcctgctcattttcttaggtatttgcaggaggaaggttctgtaacaagtctatacatgaccatatttacctaaaatcccttgattattagcttttcaaaggtaagttattggtatttcttgtggtaggtgtgtaggtgctgctcatctgaaaatcatatgcttcaaaattaaagagcaggtgaaaacaatcccttcttacaaaggattttgccaagagagtgccttctttaaaattctgtggtttgcgacctttacttttgtggacttttttattcataaaaatacttggcacaccttatctcatcaaatctttcttcatgaccaaactatgaattatgaattgtaattacagattcggaaactgaaatttcagggaatagagggccttgcccagttactagtcctgcttgtgactggaagagataggacatgaagttgggtcttctgaccatgtccttttgatggcacctctcatttcaaaagaacagaaagatggggaaggtgtcatgtctgtatccaatgtgtcttgcacagggtactcttcatatcacagtactcaatatatgttgcccaacagtccaatatagcttaaactttgaaaattagccccaaataattatgtatgtgggtccactcatcttgttatcttattagagtcttctttgctatcttgtttgagtatcctattctggattgccccagaagcagaccctgagaagcagtttatgtgccagttgatcccaggaaatgcagggaagagtgcagggaggtgaaagaggtggataagggctatgttattagcaacaccaccatgggaagtcacatcttaatccaactgggaccctcgggaaactgtggaaaacacatctcagagttacccagtctgaggggtaggagggctggattatttatccaccatgtctcatcagtcactcattgagtgttatactttgagcagtgcttttggcctgccacaatgtgggctgagagagctggggaagtcctcaagcaaaaagccacatacgggagcagttgtaggtctgtctgagaatcacaaaggggtgtggacaaagggatttggggaagataacaagaatctttgctatgccatctattccttaagtgtttaacttctcattgactattgcaataatcaggtagccattactaataacaacagtgaagaaaatgtttatatcatatacacctaagtactagtttcaggagttggggtataacactagcattaagaacatggggtggaggtcccacactctaattaggagcatggagtgggggtcttatgctaaagttaggggcctggggtgagggtgtaacactatagttaggggcctgggtgggggtctgatactatagtttggagcatgctgcttgaatcagaccatctgggttagagtcttggctctgccacttgcaggctctatgtgaccttgggcacattagttcacctttctggctcgactttcctcctctgtaaagcaaggacaatggaattgattttatggggtcattgcaaagcttaaaggacctaatgcagagaatacacattgaattgtgtctgaggtgtgatgaacactcaatagcttttaatgatgattattattattcagaagaagcatgttccaggagaatattcatcctgtgatctgagtaagcttcctggctcctggatcccatggacactgagccacacttgttgactaactgtttttcctgagtgggtggtttgcccaccaatttgctttggcagaaaaggccttccccaataacatatagtggctcttgccttagtagcacatgcactgtggaaaaggaaaccagatttgaatccatgcatttgaggcatagaatcctatgatactgcctaggactctaggtaaaataaaaactcttattttacagattaggaaaatgaagctcagagagggaaatgtatttgctcaaggtaatgaaacttggtggaagagccagatttagtaaaaaaaaaataataataaaaaaaaaaaaaagtccttctgactcctttctttacagaataacaagaggtgatatggattgaggtatatgtccctcaccttgaatttattttattcccctctttctttctctccatctctccttcccccactcatttttctcccttcttgccaggaaaatagaaaatacgtgctgattaattgagtattctatgtaaagaattgccaagtaatttaaaaaattctgtagatatcctaaaaatattcctaataattttgagacattatctacttcattagtaatgccattatttttccttcagaaatgttcataagcaaagaaatattcttccccctcattggtaaattcctaatagttatacttagttatgttcaagtgaaaaggaattgaattatgcacgttcttcatatgagacttactttttgaaaactgacttttcctccagatctctgttctctgtgaatctgtgctacagctcagctggtctaacaaccaagctgtcttgtggcgacagcgccctggtgtctacagtgaggaacaatctgctacctttctttctccagagataaacctgatataaattcccatcactttacctactagctatgtgaccacatgtatctatggttctcagttttctcatctataaaatgaagataacaatagttcctacttagttttgttttatgcattaaatgagactgtgcttagcaatgcacacctgtggtatttctgtaaagccagctttgttatttctgcttccagcaatgtttcctacatattatctttaggccctttctccctcctctctattttctaactcttgcccacgtaccctagaaaaagttcaatttttttttttgagacagagtctcgctctgttgtccaggctggagtgcagtggcgcaatctcggctcactgcaagctccacctcctgggttcatgccattctcctgcctcagcctcctgagtagctgggactacaggtgcccgccaccacacatggataattttttgtatttttagtagagatggggtttcaccgtgttagccaggatggtcttgatctcctgacctcgtgatccgcctgcctcggccccccaaagtgctgagattacaggcgtgagccaccacgcccagccaaaagttcaattttaattttatttttgaataaaagaaataaaggacaactgcccaagcttttccttaattcatatttattaaaattattccaatggaaccacgatcatcaatttcttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgaccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccctgatcatcaatttctaaagcccttcaaaatgcctataaacccccttagaaatttccttaagtgtatccatatgtcacttaatcctttaaataaattttccgttaagcaccatgtttaaaaatagctcttttcttttattgaaatacagtcattttgaaaactcttcacgggcattctgttttgtttatgtaaatagacttaatcttgttcatccattcgttcatccatttccatccgacatttacatgtcaagtcctgtgctaggcaattgcagactctactagttgatgtaagaactatcttgggaggcagttattctaactccatttaacggtgaagaagttgcgacccagagtagagagtgacttgctcaaggtggcacgagcagtaaatgatagacttggctccgaatccaagagatccggacccaggtaagagactctctcctctgccctttctctaggagagacatttgagaatttgaaaatgcacaggctcccaaacagatgtgttccatgacaacagccaagatatatcagcaaatagaactcatgccctgcagcatgttggaaagggtgggactggagtgcacacaggaagctcctcccctcacaggatgtatgccaggtctgtcctctcatttctgagaggagcttagacacccacctgctcaggcatgtgcttcctaggtagggaggcaggggaggctgctgagcaactagggatgaggaggtatagcagatgcttcctggggtctccttgcagagccttgactcaccctgactctcagtgggctcctctggctctgctgaccaccaggtgagaggctttggtccttctctagacctcagtttccttgcctataatctcatttaatgagctatttaaaatctcagtaaagtcgaaaccttgatagtgcttacttggcacatggcaaattattaccatgtggaggtagccaggctagtagctaagaccattggcactaactcttgcccaagtaaccagagaaagctcaattgtaatttcatttttacataaaagaaataaagtgcacacccaaacttttccttaattcatatttattaaaattattccagtggaaccactatcatcaatttctaaagcccccccaaatgcctagaaatctccttaaaaatctccacaagtgtgtccatatgtcacttaatcctttagatatattttctcttagtcaccaggtttaacccagtttaaattcccacctctccacttccaagctgtgtaaccacaggtaagtcgtatctctggctctccattttcttgtacataaaatgaggacagaacaggagttcctgcctcttaggtctgtactggggattaaatgagataatgcttagcaacatgtttaatgtgtggctgtattagtccgttttcacactgctgtgaagaactacctgagactgggtaatttatgaagaaaagaggcttaattgacttacagttctgcacggctggagaagcctgaggaaacttatgatcatggtggaaagggaaggggaagcaagtatatcttactgtggtggagcaggggagagaaagtgaaggcggagatgtcatacacttttaaaccatcagatctcatgagaactcactcactatcatgagaacagcataaaagaaaccacctccgtgatccaatcacctccaaccaggtccctcccctgacacatgggaattacaatttgacatgagatttgggtgggcacacagagccaaaccatattggcaaaggcccaatcaatatcaatgattacggcgattcctcttctgcctgtcattaatcccctcagtgtttgctgggaacggactacgtgccaggaacccatgctggggcatcaatggtggcagaaagctgattcaacttctgccttcaaggagccgtcagcatctgaggtccactgagtcaagaaaaccagccctgagcacaagattaacgttctccttcattgggcagtaataataaaaatagttaaaatttattgagcactttctatgtgttcttgaaaggttttccctttgtagggtttctaattattttagaaaaggagtgataaaatgtcatcagatatggcatcagacattgttgatcttgggcaaggaagatcaaattatcaggagtcactggtctgaactgaaagagcaaaggaattttcctcctgttgtatccagagacactgcaaaagttagaggcagaaaatatcttagggaccccctaggccagccccaacccaatatttcaggtggggaaactgaggctagagaggtggagtgagactcccagtgtttcagaggagtaggatccaggacttccaaactagcctgattgactgctctactgtgtcctccctaggaattcctggtgcccacccatgcttagactgttcccactgctggaaatgcccccgagctttggaaagatttcaaggcacacaaggatatgggtaatttacttcacatgagcttggctcccagtataggataaagaagcaatggcgcctttttccccttctacacagcccaaccaggtagccagcataagtaactacacaagcctgtggtctcaccacatgggatgtgttttctaaaaaaaaaaaaaaaaaatggaaaggagacttctccaggaatgggcatgagacatgagcatgtattaattaggcaaaaggggcaggtccctccaccactaccttattctcgatcacagcctcatgtttatttatttccatggattgcatcatcatctttgcatttatcttttgcttgttcattgtgctcctcgagggcaggcatcttgtctctttttctccctgttgcttgccccatagccaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccggctaattttgtatttttagtaaagccggggtttctgcatgttggtcaggctggtctcaatctcctgaccttgtgatccgcctgcctcggcctcccgaagtgctgggattacaggcgtgagccaccgtgcctggccagaaattctttatgcagttgaggagatggagggctaaccagggtgcacgttcagtgagagcctgggctgcgatggggaggtgggacaggagaggcatcttgtgaggggccagcaggggtggattctagggtgtctaggaggccatgcttggggcaggagtttgcaggcagaagctgtaggcctgttggagggttttaggaggagaaagacaggatcagatttgtgatttgaaaagtgtccccgatgcagagtgggatatgggtcagcagaaggagggtgtggaggcagactgggacactggttaggaaacagtagttcagaactccagaaacaaaagggaagttgtttgtgaaaagaagttcgtgcctctcagcattgttaacaaccatacatggtgattctaacttgaatttgtgtaggatcagtcatgagacttagattgtttcctgaactctgctctagggaaatgtaaagtggttcttcctcttgactatcaattagcatgttttgacatagactttcttccagtgggatttaaaatctgtgttctttagttgaatcaataggcttgaacattaccatcctggactgtctgggggagaggatgtttttgaagagtctcaggagcaaatgggccatgaaaggccaaattgactgttaattctaattaaaaagaggaagctgctacagcataatgagtgtggacagttaattagcaggtaagaaaacacaattaaagtctctcagaacaaacctacagtgatgtgttctgtttggtggtgagttaagcacactcagatgacctgtttctaagcttggtgaggagtttctgtttcaatagagacggaggtcagcagtcttgctggtaggttctcatgggcgcattttaacattcttcctttttggatgagcatggtgctgggagggggtgttgaaatagaaaagcaagagtgactagataaaagatggtcgagctaggaggaacatctcccaccgagagaccgggacatcaggaagactggcacactcaagccacatcttcagagagaaggcattgagagtggatagagggaggatacagatgctgggctgaagcagggaagtctgggaaccctgcacggggctgctgagcaatgggacttgtttcctggcccccagcgactcctggggaagggatgagttgaacaggtgaggaatggcccgctctcaccatggacctccagaatcctagcagcaggataccccacaacccccacagacacttgagacgacagggagaactgcttagacaggtggcaggggcaggactccagcctgtgtgttgcccagagggtttggtgtgggaacatctgcagtgaagcatggccagtgatgcccattccccaaggcttgccatgctcctctaggagtgtgactgtcagacctggacagagcagggtggccttgcctgtgggatgaggccggtacattctgaatgccccccatctgctggactctcttggggccccagcctggttgtgcccagagggcagtatcagatgcccaaccagggtgcttccctgggaccctcttcatggcttctttgccagcagaccatgtcagaccatcgaagaactctagcagactggctcccactggtgtgcaccagctcacccacagcctcccctcaccgcagcctcccttcactggtgcacactcattcgtgccccactcccccaccatcccacatcgctttgctggtgcactgtgagtggaccttgcctccctctcttccagcacatgtgtgtgcattcatcacataatgccaccactgctggcatgtgcgtaccctgctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacttgagcgagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagtagcctcaaagattgtaggatcatcagtcaacacagatgagaaagaaccagtgcaagaactctggcaactcaaaaagccagagtatctttttatctccaaatgaccacactaattccccagcaatggttcttaaccatagtgaaatgactgaaatgacagacatagaattcagaatatggataggaatgaagatcactgagatttgggagagtcaaaacccccaaggaatctaaggaattcaataaaacaatacaggaggtgaaagacgaaatggccattttaagaaaaaaccaaacttatctgatagagctgaaaaactcacttcaagaatgcataatataatcacaagtactagcagcagaatagcctaggatgaagaaaaaatctcagagcttgaagactggttctcagaaataattcagtcaacaaaaataaagaaaaaagaataaaaagaatgaacaaaatctctgagcaatatgagattatgtaaagagagcaaatctatgactcactggtgtctctgaaagcaagggagagaaagcaagcaacttggaaaacatatttgaggatattgtccatgaaaatttccttcaggaaatgcagggaacccctgtgagatactatataagatgaacatccccaagatacatagtccgtcagattctccaaggtcaaaatgaaagaaaaaatgttaaaggcagctagagagaagaggcaggacaccaacaaagtgaaccccgtcaggctaacagtggatgtttcagcagaaaccctataagccagaagatactgggggcctatatccagtattcttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccaccgcgcccggcctccagtattcttaaagaaaagaaattccaatcaagaattttgtagccagtcaaactaagcttcataaacaaaggagaaataagatgcttttcagataagcaagtgctaagggaattcattaccaccagatctgccatataaaagttcctgaagggagtgctaaatttggaaaggaaagaccattactggccactacaaaaacacacttaagtacacagaccagtgacactataaaacaactacacaatcaagtctgcataataaccagttaacaatatgatgacagaatcaaatctgcacataccagtattaaccttgaatgtaaatgggcaaaatgccccaattaaaaggcacagaggccaggtgtggtggctcatgcttgtaatcccagcactttgggaggccaaggtgtgcggatcacttaaggtcagcctggctaacatggtgataccccatttctactaaaatacaaaaattagctggatgtggtggtgtgcacctgtaatcccagctactcaggaggctgaggcaggagaatcacttgaacctgggaggcagagattgcagtgagccgagattgtgccactgcactccagcctgggcaacagagtgaaactccctctcaaaaaaaaaaaaaaaaaaggcacagagtgacaagcttgataaagaagccagacccaactatatgctgtcttcaagacacccatctcacattcagtgacacccgtagactcaaagtaaaaggatagagaaaaatttaccaagcgaatggaaaacagaaaaaaatcagggggttgctattctaatttcagacaaaacagattttaaaccaacaaaaataaataacacaaagaagtgcattacataatgataaatgactcaattcaacaagaatgcctaactatgctagatatatatgtacccaacatggagtacccagattcataaaacaagttcttagagacctacaaggagacataggtaaccacacaataatagcaggagatgtcaacaccccactgacagtatcagacagatgatcagggcagaaaaccagcaaagatatttgggacctgaacttaacactgaccaaatgaacctgacagacatctactgaattctctacccaaaaacaacagaatagacattcttctcatttgcacatactccaaaattgaccacacaattggccataaaacaatattcagcaaattgacaaaaaaataaaattataccaaccacacccttggaacacagtgcaataaaaatagaaatctttactaagaagatcactgaaaaccatacaattacatgaaaattaaacaacatgctcctgaatgacttttgggtgaatgatgaaattaaggcaaaaataaagaaattgattgaaattaatgagaacaaatatataacataccagaatctctgggacacagctaaaacagtgttaaaaaaaaaagttcacagtgctaaatgcccacatcaaaaagttagaaagatctcaaattaacaacctaacatcacacctagaggaattagcaaaccaatcccaaagctagcagaagataagaaataaccaaaatcagagctgaactgaaagaaattgagacacacacacaaaaaatacaaaatatcaatgaattcaagagttgatttttttaaagaataaataagactgataggccactatctaaactaattaaaaaagagagaaaattcaaatacacaatcagaagtgacaaagagacattatcactgaccccacagaaatacaaaaagccctcagagactattatgaacactgagaagaaactgataaattcctggaaatatacaacctcccaagattgaacaaggaagaaactggaaccctgaacagaccaataacaagttctgaaactgaattggcagttaaaagcctaccaaccaggaaaagctcaggaacagatggattcacaactgaattctaccagatgcataaagaagagctggtactattcctaccaaaactattccaaaaaattgagaaggatggaatccccttcaactcatcctatgaggccagcatgatcctgataccaaaacctggcagagacacatacatacacaaaataaaacttcaggccaatatccttgatgaatatagatgcaaaaatcctcaacaaaatcctagcaaaccaaatccagcagcacatccaatagcttatccactatgaggaagtaggctttatccctgggatgtaagattcctttgacatatacaaatcaatagatgtgactcatcacataaacaaaagtaaaaacagaaattacatgatcatgtcaatagatgcagaaacggctctgataaaactaatatcccttcatgttaaaaaccctccacaacttggcattgaaggaacataccccaaaataataacagccatctatgacagacccagagccaacatcatactgagtgggcaaaagctggaaacatcccccttgagaactagaaccagataaggctgcccactcttaccactcctattcaacatagtactggaagtcccaactggaacaatcaggcaagagaaagaaataaaagatgtccaaataggaagagaaaaagtcaaactatctctgtttgcagacaatataattttatacttagaaaaccccatagtctctgccaaaaagcttcgtgatctgataaacaactttaacaaagtttcaagatacaaaattaatgcactaaaaccagtagcatttctgtacaccaacaacatccaagctgagcacaagatcaagaattcagtcccattaacaataaccacacaagcatacaaaataaaattcctaggaatagagctaaccagggaggcgaaagatccctacaatgaaaattacaaaacactgctgaaagaaatcagagatgacacaaacaaatagaaaaacattccatgcttatgataggaaaaatcagtattgttaaaatggtcatagtgcccaaagcaatttacagattcaatgcaattcatgtcaaactatcaatgacatccttcacagaattagaaaaaactattataaaattaatataaaacccaaaaagagcccacatagcccagatcctaagcaaaaagaacaaagcaggagacaacatggtacctgacttcaaactatactacaaggctacagtaaccaaaacagcatggtagtggtacaaaaacagacacatataccaatggaacagaaaagagagtccagaaaaaaggccacctacctacaaccatctgatcttcaacaagctgacaaaaacaagcaatggggaaaggacttcctgtgcaataaatggtgctgggataattggggaactatatgcagaagactgaaactggacctcttccttacacaacgtacaaaaatcaactcaatatggatcaaagacttaaatgtaaaaacctaaatctataaaaaccctggatgaaaacttaggaaatatccattctggacataggccctggcacagattttatgacaaagacgccaaaagccattgcaacaaaaacaaaaattgactaatggaacctaattaaactaaagagcttctgcacagcaaaagaaactataaacagagtaaacatacaacccagagtatgggagaaaatatttgcaaactatgcatctgacaaaggtctaatatccagaacctgtaaggaacttaagcaaatcaacaagcaaaaagcaaataaccccatttaaaaatgggcaaaggacatgaacagacactttttaaaagaagacatacacgcaaccaacaataataataaaaaatgctcaatatcggtaatcattagagaaatgcaaatcaaaaccacaatgagatatcatctcacatcagtcagaatggctattcttaaaaagtaaaaaaataacagatgctggcaaggttgcagagaaaagagaaagcttatatactgttggtgggaatgtgttagttcagccactgtggaagcagtttggcaatttctcgaagaacttaaaacagaaataccatgtgatccagcagtcccattattgggtacacactcaaaggaatataaattgttctaccataaagacagatgcatgtgtatgttcattgcagcaactattcacaatagcaaagacatagagtcaacataaatgcccattaacagtagactggataaagaaaatgtggtacatatacaccatggaatactatgcagccataaaaaagaaaaagatcacgtcttttgcagcaacatggatggagctggaggccattatcctaagtcaactaatatagaaacagaaaaccaaataccacatgttctcaattataagtgggagctaaacattgagcacacatggacacaagggaacaatgacactgtggcctacttgagggtgagggatgggaggagggtgaggactgaaaaaacaggtactatactatgcttattacctgggtgatgaaataatctgtatatcaaactcctgtaacatgcaatttacctatatatcaaacctgcacatgtacccctgaaacgaaaagttaaaaaaagaaaaaagcgttctctgtatgggtgctggagttataaggctgcctgaaatagggtaaaaggatccaggggacatagctcagaacctgggttcccactcattcctgtgatttgaggccatcgcaccctcagtctaggtcttggttttcccagctgcagagcatttgtttgttcattcagtgaacaaaaagtactgagttcctgcttggagggggcgcagggttggatactgaagatagagcccggaaggagccacagtccctgggccagacagtgtctcaaatcctgtgcagttctgttgttctccggctcagaccctggaatgctggggcagatgtggatgactggttctttactccatcttccctcaccatctcaggctgtcccacatccacctgccggctggcatccctggcagaggcttttgttggcttttcacaagccagaagggctgtggaactgacagagcttctctccagggtggactgaagagagctgatgccctaatgcttcctgtgagatgatgcagttgtcttcccccacagtctcccagagttccccagagaatcacactgcaggtgcccacagcaggaacttgccctgaaatgcactccatggctgcctgcctggccctgcctgactcagtgcccactccctcctgatgtctcctgggatcaccccccaaacagactgccttcactggaatctgtgtcttagggtctcttggagaaacacttcccagcttttcaaagtcctgctatcccctccactgaagcctactctggcatgccctttactgaactcctattggtttctaatctacactgccacggtacctaggggaacaaacttattgtcccagctttaaaaataggatgtcccatgtctcagaaaccccttcagagtcagcaaatcagagcagttggtcactctaatagtatcacaatttaattatttcttgattacctaaaagggtttattgtattatgatatggggagaaagaacatactgagttgtaaatggttctgagacactaaattgatctgcatagggaagcactgagtagaaagaggggaggtgaaagatggaaaggtacagaggttcaaatatgaagtagacctgggggcatggagtgggcaggagctggactttggcggtagcttgatactttagcaatgctgaggttaattgatgctgtgaacgcatttcaacattagtgtctttgtgactgtctagggttctctttgttaatggactgatgtttccatgcatgcactttatcaaggctgctatggtggaaaggggtggcatttccatgtttatcagggtttttcctttgcattcccttcattctccctcataaaagtccttgagtgtggcactgtccattttattgatgagtagagacactatgctgtttactttccaaaatcagacattttgagagtgtaaggggggatggtattaatagtcacgtcaggatgtcaggcataatctgagagtgtccccggcaaactactgatgagggcacaaggtaaaaactcttagctaaggtcccacagctagtaaggcagaggcagaggtggaatgatggttaatattgagtgtcaacttgattggattgaaggatgcaaagtattgttcctgggtgtgtccgtgagggtgttgccaaaggagattaacatttgagtcagtggactgggagaggcagacccaccctccatctggttgggcaccatctaatcaggtgccagtgctgctagaataaagcaggcaggagaagatggaagcactgacttgctgagtcttccagccttcatctttctcctgggctggatgcttcctgcccttgaacatcagactccgagctcttcagcttttggactcttggacttacaccagtggtttgccagggactctcgggtctttggccactgactgaagggtgcactgtcggcttccctatttttgaggttttggacttgaactgatccaccactggcttccttgtgcctcaacttgcaaatggtctatcgtgggactttactttgtgatcatgtgagtcaattctccttaataaacttgttttcatatatacatctatcctattagctttgtccctctaaagaaccctattataggtgggatttgaagccaggtctattgggctgtccacggggtcctctccgtcaaggtgaacaccttaaacaaacacatctaccatgtgctgaccacctacagtgtggccttccatgcagagctatattgactggtaagactctttctaggtaggtggtcttatctccaatttacaaatgaggaaactaaggcccagaaagatggattgcctaaagtcattcacctaatttgtggtagagatagaaattgataaatggtttttctcctataccagccatgaggccaagtgagggagcatagagactgaagcccttgttcagattaaaacaggagatcctgagggtgacagaacaggtgaagtgaggtctgctttaagcactctgtgcacaagtgacctcatcagcctttgctactgtttctgacttctcttggaagtttcttccagtgaaaagtgagcttatttttcttttccaggtgtcttcctccaacttgcacagcctgcagctcctattgctgtcacatatattaatgctgatatcaaagcccctgctggaagtcagggagcgcctgctctctttgcagaaccggcagccccaggtgtgctatctttccccagttggctgtgacaagcggcctctgcaaggccgaaccatttccagatccaaaagctgaataccccttggctgcactcagcccccagctcctgagggtgtggagagcaaaaaccttcctgctgagccctgacagctgctcagtctgggcccctttccacagcctggcttcttcctgccaggagaaattcatcttttcacagcagagggagtgagaacagcccgcagttcctgttggatggcacctgctatctctctgccccctgggtagtaccaggcgttctctgtgggaaatgcccttcctcctccttctcctccctccctgtctgcctgaaaaatgactcaactttttcaattcactgcacatcactacctcttccctgccttcgaggctgttggggtcttcctctgttcccacagcccctgcccagccatctggcacagcctcctgcacacagaaggacactacttgtcatccttatggattcatgagtggtgaagcgacagacctggcacagatgaggtactttgtgagggtgttgaacgaagatggggagatgaatggatgggtgtgggaacacatgaacaggagtatttagaaatgaattaacgactgacccagtaaacaaacgaacaggtgaaggaacaagaactgatgagctgaaaccctgccttccccaggacaggactgactttgaacttggcttcaagactcattcatttcgtccctttaggagtgacgttgtccctttcagggccccacctttcccatctagggctggacttcaggccagcctggctcccttgtgcacctcaattgatgggcaactcattcctttttgacagagagtccagttttctgatggagcccaaatatgagtatcgattgtctcccaggcccctgatcagatatcacaaccccgggaagtcctccctgaagcctgaggctggtgcatgcatcttcggagctgcgatcatgaatgctgaatgacacacggggcctttgtaccagctgctcctctgcctggattgctcatgcgcagatgtgtgcgtggctgcctccttcttgtctcctgatctctgctccatgatcaactctgtggagaggccttccctggctaccctaagatagcattttctccatcattctcctcctcattttgcatgacttctcttctgagcacttattgctacacgtattagtctgttctcccattgctataaagaaatacctgagactggtaatttatattaaaaaagaggtttaattggctcacggttccaacaggttgtacaggaagcatgatgctggcatctactcagcttctgcggaggtctcaggaatcttccaatcacggtggaaggcaaaggagaagtgaggtgtctcacatgatggcagcaggaacaaaatagagggtggggaggtaccacacacttttaaacgatgggatctcatcgtttaaaatgatgatagtgagaactcactatcacaaggacagtacaggggggatggtgctaaaccattcatgagaaatccaaccccatgatccaatcacctcccaccatgccccacctccaacactggggattacaattcaacatgagatttggtggggacacaactccaaaccatataattacattatattttcatgtgtttacaataagcctccctcaacagaatgtccattccttgagggcagggattttgtttgtttgttttgctccatgcactgctccaatttctacattatctgccatataggggctcctcttggcatatggggcctctataccaatagtttctggtataggggctcaataaatatggataagtgaatgaatgaatgaatgaatgaatgaatgaatctggctgtgtcctcatccggagagtcttattcatctttgcatcccctgggtctagtatggaaccaagtatgtcgtaggtgcttaaaaactacttgctgaattaatgattaaagtacagacacatctttcacattttgatcaaatccttcctctgcttcaaatctccaatggcttcccatggtattgaaagtaaaattcctgattccttaccacggagttatgagatcttctatcctccggcccctactatccttccaacttcatctctttcctttgctaatatggaacatcataatattccaccccaaaacacgaagaactgttgagctgaaggcatgtaaaaagaagtagatgcaggaaggctctctgccttccctctatttgcctaaaagcaggacatagatttacaaagacaagagatattctgctcccaccctcttctgccagggagaacaaagggtaaccagtgaagacaactttggatgcttataggtctggagcttacaccagaggaacctacatgaaccagtttccctaacccacctcgatctgctatttatttgttttcccccaagttgctgtcactagagactcaacgttcttttcctttgtcttgttgcttctttcaacatttactgttctttctcgaagctggaatttaaagccacttctttgagcactactcattccctgggtgtctcccatgtatgtgtgaaatatacatgttaataaacttctgtattttttttcttgtgttagtctgtcttttgttacaggggtctgtttcaactaaggacctatgagggttgaagaaaatatgttttttatcccctatgctaacaacactgcagcctttcctgagccttccaagcgagttcctgcctcaggacctttgcacattcttcccctacatcctcacagggtggcttccttctcagacccaagtcctgcctgcagcgctagcttctcacggaggcccttcctgtccatatcacaaaagcagtcctctcctcccatcaccctagccccttaccctgtttattccttcctagcactggtcagtaatcctcaatatttattagcttaccagtaatggctctataaatatacatttgtagtggcctgtgtcattcgctggggtatctcctgtgcctggatcaacataagaagtgcttgattaatacttttaattaacaaatgctcttgcctatcaaccttgcttttccagctcctttctattgcattggacaataaagcacaatgaatgtgccccgcccagggaggccaactgttatcagtgtacatgtcttcttgattggattatgagcttgacggggaccgagaaatgtctctgactctacttctgtgtcatcagtacagagtgtagtacctgatacatagtatgtgttcaaaaattttttttgttttgagacagggccttactctgtcacccgggctggagtgcagtggcatgaacatggctcactctaacctcgatctcctgggctcaagccatcctcccacctcagcctcccaagtagctgggactacaggcatgtgccaccatgcctggctaatttttaaattttttgtagagatgaggtcttgctacattgcctaggttggtcttgaactcatgagctcaagaaatccttctgcttcagcctcccaaagtatcggagccactgtgcccagctaaaatcttttgttgaatgaattaatttggggcatgactgagaatatataaaaggggaaaaatgactgtgaatgatcagcatatatttcagaaaatcctgcattaaagcacatgcattagtttcctcattaagacagcctccccataggccctcttaaggcataattctgacaagcttgattttatattttaatctatattttgtttcaataaagaagttgggcatgcaaagggaagcacctaaggggtgagagaatgcatgtccgctgaccactcttttgctcgctagacctgatgaatgagacttcacagtggggtgagaatttccatcagaggctatgtgggaacaagagtgactttactttaaatgctaatccaccatgtaacttctgactaaccccacgtccaggaatgcctccaagaagtcgagttgatgtattgctctttatgtagaaacatctattcactgtaagtttcctccaaaacaactcttgatgctgttgcagaaatcaaagactgtgatgcctgcagccacctacacattcctcccagagtgcatacactttttccccagatctaggccctgggactggggggttgccatacagagatctacctgtcttgtggcttcccaagaccatgcttcagtctgcaagttcccctaacaaatcaccctataccatcagactggacttgtctgcccctttctttggtttcttggcttcttctttgccatttggggattgctttgtgtacacagccatttcaagaaacaggctgccactgtcttagaaaaacaacccctggcacatccagtgtgatgccctctcagaaccagttttcttctggaaggctggtttgatttagccaagacactcatgtccccaaagcttcttgacagcagaagtgacctcctgcaagtgcccagagctgtagagctggaggggagctgccccaaacagccttctgctctccaagggcgattccatcagggttagtttccctaagacagaaggcagaaccacagcttagggaaattcttatcatagtcgccatttcttgagtgctttctatgagttggaactttattgtccacctttcagagatttgttttaaactcagaccctgcaaactgtgcatcatcttcatactatagatgggacctggcttaaggtcacacagctgttaagcagggtcccagctctccaaacccaagcctggaagagtacaaattctgcagcttctctacaagctatccatctgggaagcataaaagagagaaaatgccatttcatatttccattttcttcctgtccttgtatacttagagcataaaggatgctgtggtagacagaatataaccccaaaccctgtgcctgtgttgtctcgcatggcaaaaggggttttgcagatgtggttaagtcgaggatcttcagatagggagattatccttgattattctggtgccttgggcatggtgccttggccaggtcttggctggaagccaggagaaaggttggagtaccacctgcttccacctcttctgagctgtgagcatgaacacttgagtaccccactttttgactcacaacccacaaggtttgagaccaacttgccccaaatcacacattaagaaggaggtggagccagactggtctgagtcccaagcctatgcttcttccaaaacaccaggttagaacagcggttcatagccaggagtgattttgcccccagggaacatttggcaatgtctggagacatttttggctattacagctaaaggtaggtgcacctatcagctaatgtgcagaagccaagaatgctgctcaacatcagaccatgcgcgggagagcccccaacaacaaaatactttccagttccaaatgccagaagtgctgaagtcgagagaccctgtcatagatttttctctagtaagtcatgtaatggcatcattaaactatcacgtgctcatccttttggtgggtttgtgaacaaaacaaatttgtatgagaccatttatcatttctttctagaactctgaatttataatttatattgttacagagtacatttaaatctgccttaataaaggcaaggaggcaaagaaggaaattcaaactcactaagcaccttctgtgtaccaggcaccatacatatcgcttagcagtctttatatagttcttcttgcataatagctctcaaggtggaggcttagggaggctggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcaggaatctggccccggggcccatgatttgccattttggcaaacagagcatttcaaagcatatggctcccagacgcaaggatgtgatacagagaagtgaggcacagccgagcacttcacccaggacccctctgcctccaggtagtggtttcattcctcaagccattcaggagggcaaggagggacttgtggcatgggggaaagggccccagtccttgctttgatactgactgcaatatgcagggcccgttacttattccccagctttctcatctgtaaaatgggtgcactgatccaacagaatggatatgaacatggatgctaattactattgtattattattataccattattattattaatattattattattattattgaaagatctggctcagggcagctcccctctgttgagaacactctgggcacacctcctccaatatgttaatccacacaacagcccatgtgatcatttgaaatagaattgagatgaagtctgtcctctgatgcaaacccgccaagcgtttcccattgcatttgaaatccagctgctgaactgaccaagctctgtggccatggagtttgcttccttcctgctctcttagttttccttcactttgaccctgttgattccattccagtcacacgtgcctccttgttctttctacaactgcccagtattcacgctcatgtcagtgacaacccgagaactggggaaggaagatggggctgagacctgggatcccaggcaaaatggcacatccatggatacggggacgatgctgccattactcctcctaaggcaggagctgtgaggaaagcagtggcagccagcaccttggacgtactccccatccatgcgtgtgagctgcatctaactcgcttcatgtatgttgtctcctcacagcacctagcacccattttacatgtgggtaaactgatgcatgagggtgggaacaggccagcaccactctactggttgcatggagaattccaaccatggtgggtggactctgagctcacagtcctccccacttcatgttggctgtctgggaaaatcatcttttgttctttacacatccacttttggagcctagaatctcctgaatgctggtcacactgctcccaatatggggagacgaacagtagtccttcaagaactttttgtcagcgtgaatcttgcctttcctcagtttaacagaaaaacaatgggcagcgtgtgaatgcaatgggcacttttccatcctagcagtttatttttgacacctcacagaagtgaatcattgtcatgtaactacatctcatttgcaaaagtacaaattgaaacagagttaatgccaattccctcagcttccataagagcttggtaattaaagctgctaaagaagaaagaaagtagacgcagtgtttccttcaaggcctggttccgctccccaacccagcctgcactctctgcagccatgtgggtttctcatgtcagctgaggcggctggagtagaatgtctccctttctttctcaactaactcttgagtttcttgtgaaaggagataatgcaggtaaagtacttaattccatgcttggcccataataagtactcaataaatagtattggtgataatgatgataatgatgaagaagatgatgatgattattttgacattaggaatggaagagaaagcggagaagcagggaagatttctgtagagatagacgggcggctattgctaagccataagcccctttccctcgccccatcatggggagtacaggggagcctcactcaacccaagcctgggaagagggactcacactaccccctgagagctggggacaccgtggatggaggtctgactgcctgactgcctgggagagagatgggctaatgatcaactgcttaaaacgatgtaggggttgaaataatattcctgagatctaatggactgcccccctatgcaggggactaaacattaagcctctgcatgctgatcccattctgtgaactggtgggagtgaattcacacatgcaactcacatgcgtgccccccccacccgaggccctggaatgcactgcccagacacactcaattacaggcctctgagaacgtgccttgcacagtcacacctcggcaattctgcccatgctgacttctccaccaggcgtgtctttagcctctgtcagccttggagctgaaagatccccaagtggtggatttgcgcctgacccgggatagtcccatgccctcctctgttgtcctccaagccctctgctatgttcctgctggagaaagcggtctgttctggtgggcattagtcaagttccatctgtctcccttaccagagcgccactcatctctgatggggccatgcccagaggaggggctcaggagtgttctgacctcagagtcgcctggcagtgcagcctggtgccttcactagtccactgtggcagggcaggcagctgttcccataaactcccttgggcaggtggcccatcatgtaattagaagccaggtgacctgataataatcaactcctgcctggctggaaagcccttgactttaaagcatccagctaaccagggcttcttccccagaattgtttactaccctgaaggggaaatgctatccacccatttatttcaattgggtacctgcaccttcataaaatggcataaactaaacaagaaagtccctagagtcctctgcaccccagttgtcacctgttgaggagctcatatataggggatatgagaagtgaattgtctgtggagctgacagccagcttgaagctctccctctgtcaccccaggaacccccatacctgtgggattaactgagcgcttcataagcccagagcagaacttctcccctcagcaattttgtgacgaatgctgaagattttggaacataatgtttattttttttcaagtttgaacattgagataactaagtcagttcatgtttgcattacattttgagcagtggtgaggttcccagggggagaacagctctgtgtctgcaggaacaccccccaaaggcatgggttctgattccctctagggtcaaagttgctgacatataaaggggaatgttttccttcctccaagaggttattccctgctcagccaggctccctgatgtttttattttagtgtttatttaacccacaagtgaagacaatgaaaatggtcaactaaattctatgtattgacagagcctattggcaataatgatctcatttgactctcacactaatccgtaagacagagacagtataagtcgggatctggacttttccacagagaaaacggaggctgagaagtggatggaacgggggagtggtctccagcctcaggtctcagcatcaacctccgtctccacccagcttctagaatcaattctcacatgcaaacctggtcagtccatgcctcctgcttaaaacccaacagtagcttcccactggcttcagggcagttctacacattaaggccttctgtgttctaatttctgtctacctttgcactttcaccagctgctggttcccaattccaggcacagtgtcagtctcctgcctctggccctgggctcctgtgctcctccttcctcttacaatgccccctcctcacatttgcccagtgaactcctccctgctcaccttgctagaccacggccaaccatttcctgctctgggactcttatctgacacaccaggcagatgggatggcttggcaatatgtcaattattactcttatttgattttacgccaatctttctcccaagggtctggtggctgtcctctgctcatctctgtagcttagacctagcacagtgactggcagacagtaagtaggtgtccaatagactaggatctaacttgaatgaactgtttttggtagaggaggccaaagtgtttatcaaagcatatgagaaaacagatgcttatctctagtccagtgcagtgggctgagtggtggccccacaaatatacatccatgtcctcatcctggagtgtgcaaatattactcaaatggcaaacatatgattaggttaaggatgttgagaggaggacctgggtcctaaatgcaatcacacatgtccttgtaagagtgtggaagatggagttttgggatgcacacataggggaaggcctgtgaaggtggaggcagagactgtgtagtgatgtggccacaagccaaggagcactggcagctgccagaggccaggagaggcgtgtggaagggactcccctcagagcctctgcaggggcactgcatccctactgaagcctcgatctctgccttctggcctcagaactgtgggagaacacattgctgtcatttgtggaactttgtcacagcagccacaggaaatggatacagcccaacagaggactgtgttctcaccatctcagcagctgcaaggaataattaagtgacaaattcctcagctggattcccagggattgcccaagtgacagtgaagaggaagacagctgctgacagaaaccacgagaaagacctatgagcctgacaggtgtcactgatttcaaggactgcagagccagttttgaggttttctacatttctgttgaaaaccccagcatacgcaccaaaactttgaagggctcaaaatctttctcagagcagcatttgcttggactgcttctgaggggagaggttttctggagggttttggcaaaaaatcataaggaacactgccacgttttcgcattcaagtttcaggcgataagctcactaattaactctgccataggctgcgggaaagtgataagtactaaaaccgaacatgtgaaaatgcaagggagaacggctggaaaaaggagactttggagttgggcaggcatgcgttcaaatcctggctgggccacctaaactatgtgccatgagatgtggcccaagcagggctccctggagctgtggtgtcctcatggggagaggagggtctccttgcggagactttgtaaggattagggtgagtgtggccaagtatctagcgctgaccaagtgcttaacttaggaagatttttttggggggtgtgtggggtcttgctgtgtcaccccagttgcagtacattggtgtaatcttagctcattgcaaccttcaactcctggactcaagagatcttcctatcttggcctcccaaagcattaggattataagtgcaagccactgtgcctggcttggaagataatattattaattttaaaagttccctggtcttcttgaaaaagcagaaagtgcaccataaccttggcaggcagcttgcccactcaccattgtttggcattaagagtcagatggtggaaatcactcatttccaaagccctggtaccctgcatctacagctatgtagaggattaggaaatactttcctgccaacttagtggctatattcgttttctagggcttctgtcacaaatcaccacaaacatggggtcttaggagaacagaaatttattctgtcattgttctagaggcagaagtctaaaatcaaggtgttggcagagttggttctctctgcagactctgagggagaaaccatccacgcctctctcctggcttctggtgctgctggcaatccttggtgttcctttgattctagatgcatcgctcgctctaatctctgcctccaccttcatatgcccttctcttccctgtgtcctctccttgtcttatacggacaccagacattgaatttaggggccaccctaaatccaggatggcttcatcttgcgatccttaactgagtaatctgcaatgaccttatttctaaccaaggtcacattctgaggttctgagagaacaagaatctttgggggatactactcaacccattacagtagctaagagcacaaacactgccaacccactgacttcaggggcacctgccccataaaacctatgagttatgacctctcagaaactcagcccttcatgtgcaaagtgggaataagatggtctgtctcctgggctgccatgaggattgaatgaggtgaattgcacagccacaaggttggtagatctggccaccaattctggaggcttccatgctcaggaaagtggcttgggctgggatggctgctgaggaatcattcaggaaatatgtggaaatgctgtccctaggcctcctcagcagaacctggatgaggtccctcctcatccagggacccgggtgggggatgtttccccagggaagggggttctgaagtgcagccatgtagttagagagcccttaatctggttcatcccctcatttcactgatggtgaaactgaggccagagagggacagggacttgtccaacttactgtagattttgggaaagtcacagcaaaattccaagagcatcccagaccatctctcctgtgagttggggcagggtgcagtgggatgtggtacctctgtgtcctggccaggaatgagggctcagaaatgccatgaatgaaagtcacattgtcagctcaaggtcaattcatcaaaaagcaaagactggtaaatgcatttttgaataaaaatatgttaacaaaagaaacccagtctgtgaatgtgcaggaatccctctcactatctgaacctttgctatccagactcctgttttccaaacgcttgaatgaataaattcgataaatgtgttgctatatcgcttgctatccaaatcctatttcctgttgtatgcataaatttctggaataaaatggatttggaaagggaaagatatatatattctttttgtggataaaagtatattttatgccacttggctgaggcttctctctgtttactaacctccagctataacaacagggaactgaagcagaaggaacaacaacaaaaaaaacattctacagaattcactacgcagacatgatgaagaacttagaaactgatcaaagctgttagaaccattccattctatgcacaaaaatgtacattgttcataaatagttaaaagagataaggtaaatccagcaaattgtgtttctctatgatttgactttcagcaatgtgacctctcagtgcattgacttttgatgaattaactttcattaagttgctttgttttcttcacagctaacagctagaggggtggacccttggaaatgaccataatatgttgagactgctggaatggtcaaggtcttcaacattcccctatagcctttttgcaccatagcaatttgtgtccttattgaacattcctcagaatactccagtttgagtgtaccatatgttcccagtggggaccctgacccatgactgttattgaaggtaagatccctaagggcagagactctatgtgtgtgcacatgcatgtgagtgtgtgtgtttgtgtgtttgctcctccactgcatctccaggcctagaaggaggcccactttctagtaggctctcagtgattatttgtggaatgggggtaagtgaaggaaagcccataattctcatctcttgcctattctacagttactgcctccaggcaattgtagaatagccacagttctttgcagcccctccaatgggagggaaagtctttccccatcccttgaatctgggcgggctttgtgacttgctttggctgatagaatgcagcagaaatagtgtggagttccaagcccaggcctcaggcagttttgcacacttccccttcttttcttgcaactttgccaccatcatataaacaaacctggtctagtctgtgggacagtgatggacatgtggtcaagttacccttctcagtgccagaccaatgagtgaggctactttggactagctggtgcccagatgacctgccagctggatgtagataggaggaaatcatctagctgagatcaaagaagcctgggccagaagagcaaaactgccacactgactaactcttgcgagcaataataactggttgttgtttaatccatgaggcttggcggttatttgttacacagtcatagctaaccgatacaaattccttagtgatctttctgaattcactcttcccaagcctctcccatattccacattttacctctggtttattccctcctctgcagactttttaaacaccagtgtgataatgctatgtcccagctcaaaattctttggtggctgcccacttccacaaggacaaagtttaattatttcagcctgtgaggcccacgatgatctggccaccactttccctgcaccctgatgtcccctgaggcccttttactccagagcgtctctccagttttacatgtgtcctaggcttccattagcatcctctctgatgtctgtcctctactcagacattcctccttttccctttagctggctacctccaggtccacttctagctcaaatggcacttttgctattaaaaaaaaatgcccctttctcaaataaaatattttacaagttagtacattattgaataaacagaatgatcacaccctgtggccaggcccagccttgccaggggagttctccagatgccctctctgatggcagcagccctgcagatgcacatgtgtacccccacagctgtctgcttaccccacccgtgagccagtgtacacctaagctctgtgcccttcccacaaagtggagcaccatgccagttttggaaccgcgcagaggatgagaatcaggcctctgagagtgggctagaaaggaagctcagaggccatctggagaacggagtgcacatgtgtgtatgtgcatgtgtgtgaatcagtatatgtggatgttgtgtaatcccagctgtgtgcatgactgttttgcttgtgagttgatgtaggagatggtgcagtcctgttgtgtcagaacctggctgggagacctcacatccccacatcggcacccatgttctcacaggttagtgtctaaggtgggatgctgtgtctttagaaatggccataagttagtgtctgtctaatgtgggacgctgtgtctttagaaatggccataagttagtgtctgtctaatgtgggacgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttactctctgtctaagatgggatgctgtgtctttagaaatggccataggttagtgtctaagatgggatgctgtgtctttagaaatggccataggttagcatctgtctaagatgggatgctgtgtctttagaaatggccataggttactctctgtctaagatgggatgctgtgtctttagaaatggccataggttactctctgtctaagatgggatgctgtgtctttagaaatggccataggttactctctgtctaagatgggatgctgtgtctttagaaatggccataggttagcgtctgtctcagatgggatgctgtgtctttagaaatgtcttcttgtgcagtgcacaccctgagaacccatacttggtggctctgcttgctctgactcgatatttagaaatcagtctaagttgtacctcctctaggtaacctgacatccattcacccagacacacatctcctctgtgctcccttagtacctgggacctgcctttagcttagttgcctattgtagaccttaagaactctggctctggagtcaaactgataggaagtggaattgtggttcactgctgtgtaatccaggtaaagctcttaaccgctctgagtctcaacttcctctatccacctccccttttccccccagtgacaaagccaatgactacttcttcctcttctttacttggaaactgaactccaagctcctgattgggacatttcttattcctctttgtgctcccagggctgaaggactaattacaatgttattgacttaacctccattggcactgggcattgccctgtaaaaggacatcagagtgtggggtctgacatggggcaccaaacaaagccataggcaagagcacatcacattgttgaatttgcctgtttggttctcagaatctcaaaatagtttttgataaaagcggaaatgaatctctgccatgctttgtcgacaggggtgagaactggttcttgggaggtggcaagaagtcttaaatatcacaatggtttgcagagctgcaaaagcttagccctacctgatgaaatcttacttcttagtgtttatattcttctgttatggagaaatttaatgaaaattagtttacccctgaggtggttgaagcttcccactgttgttcgtcccaaggggcctccatctctctctggttccctatccctacccacagggctataaatagtccattcacagaactgcttttaaaatcctggcagtgcatgcttgtaatctcagcactttgggaggccaaggtgggaggataacttgagcccaggagttccagaccaggttgggaaacatagcaagactctatccccacaaaaaaatttaaaaagtagccaggtatggtggcatgcacttgtcccagctactcaggaggctgaggtgggaggatagcctgagtccaggaggtggaggctgcagtgagtcatgatcacaccactgcacttcagcctgggtgacagagcgagaccctatctctaaaacaaacaaacaaacaagcaaacaaacaaataaaaccctcttgactgtatctcctgattccctgattcctgctggacctggatgaaatttcacatttatataatagtttagagttcacagggtagttttagatagctcatcttttaagtcccttccctaaaagcctgtgtggtaatgggtgtggagtctgagtctttgtttctagacagggactagcaccaatgctggagttaattctcaccttctgtacgaattcattttagagacattgatgtgtcctgagcaatggctactatttagttttaagtctagatttgtgagacatttccatttaattttcattaaacagtttttcaaaaattatgactatatgccaagttggtgtcattatgtctcttaacttatagctatagttattttaatgtgcatatatttattccttctatgcaatactttctgcttggtccggaggattagaaagcaatttgtcattctgctttgcacacaattccctaacttttgaggggaaaggagacatctgattcgactccccctaaagtgctgggatacttaaggtaattggggtgaggccaaggccacggatagggttctttctttcatctattatttgttcattcacttgtttattcattcaacaagtaagaatgtgcccgtacctgcctaagcaccccatcccaggcagggagaccttgctgtctgctggctgagctccctcttggggcagtgcaggctggtgcacagagccctcccacccaacttggggtagtgcctgcccccctggcaggagattcagaggcagacatatctagggttgagtctggactccaccttgcctcttttgagatcatggattcaaccttgctggcatgagagaattgaaagggatcatgtatgaacaatgtttggacgaatcccaggcatttgacacacatgggttccttcttttttccctctcctgcctcctgtaaatccagtaagcaatacttattcattcccaggtctgtctcttctgtgggctcctccagcataggaggagttaaaggactgagccctttcacttgcagggcagggccaggatgtttcatggtttcttctttccagatgttgcaggtgcaggcctggcattgagataatgtcatacaagtgggtggctttgactctttatgttatctgatgctcctgccatcttcctgtcccaggctcttctgggtctgctggacacagcctttaccccttctggatctcaccaggctcctgttggggcacacctgctgtgtgcaatcctaagagcctggctgggattctcaacactgtttgcaggagggtttcctcctcggggtcagccggggccagcagccaatgcagttgagagtgccagcccccttcctcctatagaatgtctatagtggtcattctcaactgtgccctgtccctctcctcttcctctgtgggggtagagacactgtcttgctcatccttttatcttcaactcccagcccagggctggcactgtggcataacacacacacacatatatatatatataaaattgcaatatatatatatttgatttttgtccctagtttttggcccagatttcttaaaagccttgggatttctggagtaacaagagtggcttttgtcatttataatgaacccctaatgtggtgactcaggtgggtcattagatggtttcaaggcagcgctggccatgcttggagggttggaaccttcagctccatcttccagcctctaaggaagggagaggggctgcaggctgagttcagtcaccagtggccagtgatggaatcaatcatgcctatataatggagcctccatagaaacgtctaaatgatggggttgaggtgtttcccagttggtaaacgcactgaagtgctgggaggctggtgtatccacagagggcatgaaagctccatgccccgtgatgcacccccataccttctgtatgcctctcttccacttggctgtttctgagttgcagcctctataataaagctgtaattgtaagtagggcactttcctgagttctgggagtcatgctagcaaataattatcaaacctgagggtagccttgggaacccctgaatttgtagtcagcagagcagaagtgccggctccctgggactctgtttttggttggtgtctgaagtgagggcagtcttgtgggattgaaccctttaactctttctgacactctggggaggcagtgtcagaattgagctgaattgttggacacccagttgttggtggagacaaattgaagaggtggtgtggaaaacatgtgtttggtgtcaaaatacacacacacatttggtgtgagctgtggtggtagaaaacaccacacaccacacagtaggaacttaatgagtatgttttgaatgaattcatgaaaaatacaagcatttattgagtgctgacccactgtcaggctgtgtgtttggatacaggtgatagaaacaaggttcttgtctttgaagcagtccctgatgttaggaggactgaccaaccatggccattgtaatggggtgggggtggggatacactaggagttaatctagggggctgtgggagcccagaggggcgggctgtttctaagaaagtctcaagatgcagtatgagctgactttttgaagatgagaagccacacctcaaatggatgaataagggtggttgttgcaagaggggaaatagcacatgcaaaggctgagaccatgaagcgtgtgtgtgtgtgtgtatttatgtgtgtatgtgtgtgtgtgtgtgtgtttgtgcgtgtggggcagggggcagctgcctgtggctccagatggctgcagtgcagggagaatgcgggatagagagggagggcaggcagggcaggcagagacgaccacataggttctgtcaaatgctgatacgcccctgcagtctttccagaggggtcctttttccaagcaaggtatgtgctgaggcatcttccatcaggaccgctccatcttctggggtgctcagaccttaattcgcaccttgataatggcagtggccttaccgctccatcttgtttgcatctgtccactccatttaaacacaaactccccatagaggacttaacttggtgccaggcacagagtcagggcttcatgtgatttttaaaactggaattgacacattttggcaacgatcttctttttttaaaaggtgaagctcttttattttgcctcatttattagacttccctgccactgccttggggttatgcacacaaataaaatatgcagcaggaaactgcctctcttgttttctttctttgctttcacctaatttcaactccttgtcaagtcttcttacatcgacctgttcctcacagaagctgcctcaggcggcctcctggccctctcctgggagatccatccctcttctttaatcatggagagcaggcccatgagtctctctgccattcagctctgagcatcttcctgccacactttcccgggtggctcccctggggacttgctcttccctgtccacttaggaagatgcaagatggtctcatggtctaagtggcagcttttcttagacaggtaagttccctgaggctttaaactgtacactctcaatgtgagtttaaatgaagcttctaaaccctggtccatcttgtggctaaagtcattgctagccagcgaggcccaggtgctgggtcaacacagggggttgaagatggattgaggaagcggagggcaggggctgacaggtgatctgggattgggaggtgcaggtggccttccctccagggagtcccatagacactgatggggagcccagcatttaaagccctggaaatgcagcatgttctacagtcaaaagaaagccacagttgcaaacacttggaacagaatcaggatcattgcaaaaagtcttgggagggcttaggaaaaaaaaaacagagaaggctaagcttagtgatttttggttagcaaagaacttcaggcagatatgcagatgagtccaatctggcttgtttgtgtgcatgggtggggaagaaggtcaacttttcactcagatacaatgctgacatttaccgtttcttctgggaaaacagctgttatggaaaaagataactcgagaagcattaaatcacaccatgaaacatacagctttcttgccctcatgacctgcacttatcatagtggcaatgcccacacctttgcaggggtggcactgtcccagataactgccctgggctggctgctccaggcccctggctggtgtctctgcctccagtttcttctcactgcaggtctgccctgtgaaattcatgcacacagactccccaacagacctctagtgagttccataaaaccgcaaatccttagtgcaacagccaagacgctctgagatttgcttctagcttatctcctgactcctcctctgtgtctcaccctgcactccggggagtggttcctgacgagcacttagctgtcatcagatgaggcctgaatatcaatgtttgctttggttttctttctaagccaccaagtgatggtaatatattcagccagggtttaaaaactgctctagcccagtggttcttgaacttggctgcaccttggaatcatgcagtgttagaaaatgccaagcctgggccctagccctccaagattatgtcttggttggccttcagtgcagcctgagcaccagggctttaaaagcttcccaggtgactgagcaatgtttgagcaccactgctgtggctctgatggtttatttaaggttcgtttgacatgaacttcttcctatattctggcagtggctgctctcactgcctggaaattcctccttccctacctcaccagctagccctctcccaagttccaaatttcagagctgaggaactatagcaggggttgacacatgtttaaaataaaaagttagaaagaaaatatattaggcttttcaggccacatgtggtccctggcatgcattctttctttcccccttttaaaatgcaaaagccattctttgctggtgggtcacacaaactaggccagggaccaaatctgacctgtggacaattgaattgcctgttttgtgaggcagtgggttccctgtcaatagatgcaatcaagccatggctgaaggaattcctggcagggaaaccatgactaggacttaagcttctgataaatgactgaactagaacatctttacggtcttttccaaacttgggatgccttaattctaattcatctcagcccctggaaggtttcctcatctgccagatgacctccctccagcgctgaagtcattcccatgttgtgttccgcctcagttaattgtgaagatctgcatgtgtcagcacagacttcatttcaaaaccaagtgctatgatttaggtgtctttgaatttaagagacaaagaccaaagattgttcttgacctctgcattgagataatacctgaagcaggaatggctggaaccatgaaaatcaacatgcttttaattcatcctcagccaagctgatctgacaactagaaacaaaagacaaaagtatttctttccacatagacacaaacaggactgatttatgaggatcaagagtaaccccatcctgggaagataaaagcaggagccccctccccttatcctcaattctctgtgtaggccatttctccttggaatagtttttaaccttgcaagtaaatttcaaaatgggcataattccactcaatctttagcaaagagctgaggttctaggacaagatggtgaagatttaaatctagcatttgcctcttagctatgtgatttgggaaaaattactggatcattctgaatattggttttttcatctataagaggccgaggcaggcggatcacgaggtcaggtgatcgtgaccatcctggctaacacagtgaaaccccatctctactaaaaatacaaaaaaattagccaggcgtgatggtggacgcctgcagtcccagcttcttgggaggctgaggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatattcacaatgtttttagtgggctatacctggtctacttagatggtaaggtttagctatggggctagcttgctggaaaatgtcagtgttagctgaaaaattatctgaatataaaatgcagaaaatagcttctttcatggaagtgatgcatgtatgtcctttttagagccctcatatgttaaatctggacaactatgcatcctaatgtggcaaagaagaacagcaagctatctacacacacacacacacacacacacatacacagatttgaaaatctgactctattatcttatattcacctagtatttttgtgaaaattaaagcacttagaacagggcctggaatagagtaagtgatcaataaaagttattaccagagactggatttggggacagatgtgaatgtgctatggaaagtccagggtagtgtgtagaggtgaatttcttatgtttgtcgtggaacgaaaacagcatagatttttaacacttgggttcacatcctagctccaacactcactagctgtttcttatcaggggagcccctaacccctgtggacttcagtttcttcatttgtagatgagagtggtaatcctaatttgcaagcccatcttgcacagtaggggtgatgtatataaggcagctggtgcagtgtctaagttaaagttgatgctcaagaaaggctagtggctgaatgccattatgagtggaaactgagcaagtgcggcaaggactgggcaaagaacaggacagagcctgggaagccctaagccactgcttctgggtttaaccaatcactttaagggtgccctgtgggttcagcacctcccagtccacatcttacagcttagtgcctactcagccccttctatctgagttccctggtcatgattaaaccacctgcaaatacgtcctgacaaccttctagatgtcaggccaggactgggcactttaggagaggctgatgtaaaagtgccaactctgcatccagggctggccatgggacttgtcatcaccactggaatacgagtggagaagagggtgttaccccaggtcagggctcttaagaagctttctgcacagtctttctccttttcacctactggatgcagtagaccagagacactcggggttggcagagccacagcccaggaggaaactgggtgcatgtgctcatctacctgggacactagccatgggtggttctatgagtgagacatggatttctattgtgtgaagcttctgtcattcagagacatatttgttaggcagctagcgttacactgactgatacatgctgttagtgactcagaattcagactgcacatgtgaaacattcaaggtgcctgctcaggagcatgttacttttttaaacaatttttttagaaaagagatgggctttttttctctagcaccctggctagagtgcaatgctgccatcatagctcattgtaacctaaaaattctgagctcaagtgagccttctgcctcagtctcctaaatagctgagattacaggtacattccactactacacctggctagaaatgtttttttttttaattagtaaagttgggcttgaagatacaagaccattttttggagggttggcaattaagaagccattggccatctgtgcaacagtgtatttgttggatggaggaaagtgtgggagaatgtatgtgataatagacaaacccttcagttttgactttaaggtattaaaaacctggttctcagaaataccatttgacccagcaatcccattacttagtatatacccaaaggaatataaatcattctattataaagacacatgcatgcatatattcattgcagcactattcacaatagcaaagacatagaatcaacccaaatgctcatcaatgatagactggataaagaaaatgtggtacatatgtaccacggaatactacacagccatgagaaggaacaagatcatgtcctttgcagggacatggatggagctggaagccattatcctcagcaaactaacacaggaacagaaaaccaaacaccacatgttctcactcataagtgtgagctgaataatgagaacacatggacacaggaaggggaacaacacacactggggcctgtctggggtgggagtggagggagggaaagtatcaggaaaaatagctaatgcaggctgggcttaataccttaattgctgtcgataagtacagcaaaccaccatggcacacatttacctatgtaacaaacctgcgagtcctgcacatgtatcccggaacttaaaataaaaaagcaacatgtatcccatgaaaaaaaatatggttctattttatcttcctcctgcctacccctgctctcctctccctccagcttggcatacaacaggtgctcaataaaggcttgagaaattgataagaatggaattcaaccttatatttgttctttctctgaaaagaatcttggtattagcttgactaatccttttgctccatgcaattggctagtgccaccttcatatttttctgatatcattaagccccagctgcctcttccctggagctcagggatattgcaggaaaaggggtctgctctctccacttcttctctcctccaaggtttgttttgaaaaaccctgctgccagggcaggctcccgtgttacgctgctcacaaaagcacacatcttccctgccagcctttgctcagttattttattccctctctaacaagtacttgtggagccttactatgtcttcagcacagttctaggttatcaggataagattgtgaaccacacaccaggtcctttcatggagcttattttctagcctggaggagacacacattaaagacagactgcagcacacaggccgcatgcagcccactgcctgcttttgtaaataaagttttactgggacacaaccatgcagtccattcatttactcgttatctatggctgtgtccacactaccatggcagaggtgagtagttgtgatagagaatgcatggtctgtgaaataaaagtatttacacctggccctttgcaggaaaaatcttcccatgtctgcattaaacaaatgagtacgcaggaaaccaacatgcctgtgaacaatgctatgatgggtgatgagatagagggtaggtgtgcatgtgtgtgtgagtgtatatagtaaatgtgtgtgtgctggttttagaataagtggccaggagaggcctcactgagcagctgacatctcagaggggacttccacaccagaggcaagcccctctgggagcagagactgctcctgtctggtttgctcacgcatgtccccaggctagcatagggccgtaggctggacacctccagagcactgatgtgaagatgtggatgtgaggttgtgatgcagatgccctggaagactaaacacatttactcctcgcgtccactgtaaactacaacatgtgctgtgtgttcatcctctaattcgctgccctgcctgggaggtgcttgctttctttttcttgcagccgttctgaccaccctcatagcactgtgtgtgtgtgtgtgtgtgtgtgtgtgtgtgtgtgtgtgtgtgtgtgtgctgtgtgcatgtatgtgcacctgatgccctccccaaccattccatggcccaccttgccaccttgccatcttattataatatcccgatgtcctgaatggacactttccatccaccatgaatgcaatagaacctggaatgtaatggcttacgagaatcagcaacacaaagggagaaacagaagttcagttccctttgttctgatagaaacttactgtttgcatccaccaagaaacacaaccaaagaacagccatgaatatcatcccatgagagagcacatggctgtgtcagaccctgccctgagccccccttctcagtctgaccttggactctgctggaggtccctgctggacgtggacacagggccagggaatggtagggtcctcagttgcattgcatccttgtcgttgtacagatggggaaactgaggctaacaaagagaagaagtctctcctactgacccatggctaggaaacagcagggctagaagtgagtcccaggtaaactgaggctgggatactccagctgcacactcacacagctaccatgtaagctggtggttggggcctgggcctggcagtcaggccactccacctactcgctcatgcaagtcaccttccatctctgtcttctttggcactgtcctgagccttaaatgagctcacacaggtcaagttcttagccaagtataacacaaaatcaatgaacaatatgtcttagacatgattattgccacatctttcaccatagacggtaactgcttaggcacagactgtgacttggttgtctttgattcaacacaaaccagtgtcacctctggatcagagccctcccgcgtatgaactgctcttgctgtgtggtgggaaattatctcccactcatcttcaggtgagtccactttcaccttctgtgggatagactgcagacagtcggctacatttaaattgggccaaaagaaaggcagcagacacacatccccagtcaggctttgcttcttctgggctctgggttccccatctgtatgaggagagccccccagcttggtgatgccatgagtccctgggcggggcagtggggagggtggggtgccttacctggcccactgcagaaagaggcgatgatggccagaatgcccacgatactcaggtaggggacccagggggcgtggtcctgggagagaacagggagtggtcaggtgaggaggtgatggtgtgaccggaggacctgagttcccaccccagctcctcctccatccatctgtgtgaccttggacaggtcacttgatgtccccaagccccagcttcagcatctataacatgggaacaatgataacccttcggtcactccatctgcttattttatagccatgatgaaatcagatgaagcctgtgatgagtttgacatagtcctggcatacaggaagtggtaaataaatcaataactcacattgattgagggcttagttggcatcaggcaatatgagcaattttcacagctttatcacatttataaaagttcatcattctcagcaaactgacacaagaaccgaaaaccaaaccccacatgtctcactcataagtgggagttgaacaatgagaacacatggacacagggaggggaacatcacatgctggggcctgttttggggggtggggggctggaggagggatagcattaggagaaacacctaatgtagatgatgggttgatgggtgcagccaaccaccatggcacatgtatacctatgtaacaaacctgcacgttctgcacatgtatcccagaacttaaagtatatatatacatatatatatatatatgtatatatatgaatgtttcctcatatacattttaaaggcttctatattttgcttaaaagaagttatcttagttctgatattattacataaaggaccttatttgtacccctgccatcttgcaaggtgtgagatgcgttaattcatttcatggaatatgtctggagaagctgtcactcatccggggggtgggtggcttggtgctggttgggattgctcctgctctagcagactggacagctgagcattagaacacagtgtcaccagttctgaatctgtgggggtgccagggctgccccaggagaggccacctgacttgaagggaaggtaagagcctgcgttcatctctgtaggctgagccagagtcagcccagtgggaaaggaaaggaaagaggttccagtagggggttcagcatacacaagggcatagaatcctaagagggcaccatcggcgggggggtaagctgcaaacagtctggagtggagggcgaggggtacagagggcagacagaggaatggggaactccctccttccccttgttctatgtccaaatccattagctttaggggttgagaggagcttcatggactcttgtacactgtatggcttgcttctgtaccaagtcactcactcactcactaattcagctgattgatccgagctgcccctgggtgccaggcactgggatgggaggtggaaatgcagatatggttcatgccaggcccttgccctacacaactcactcactgtctatttggagagagacatgtgccaacagtgaaagtcaatggtatgtgataagtgatctcacagggttcccccttggggcttatgggaacacaggagagagcacctcacccagacttggaagcaaggggaggcttcctgcaggaagaggtgtccaggaatgtccaaggcctcctgagtccagagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggggtttgtgggcttcaggctttccttttaaacttcggacacaagtttcagaaagacaatggcctggaacatcgcctaactggcttcctgagaactttgaaggactgtaaagatgctggagcttgggacagcttgggcctggctgtcaggaaggaactgcatctgccagcacattgtccctgaaggcaatgcttccacctcctgccggtcagcgtgcttgccagccccacctcttcaaagggcacccatcagccaccaccatgctaacagtgccttcttctagaaacatttgggccactaagacatttgacaggtgatcaaaatgtgcacctatcaatttccagatgcatttttgaaaaatgcaaagattaatcaattgctgcaaccttgcttcacgcttcccatggcaccaagatgagttggaggtactgaggcagtgttcagttaatgcaagctgccctgagccatgcagggggcagaagcccaggatccggggatctaattgccaccttttggtggtgtaaccttgggaagcttatttatttatatttatccctcagtttccttatctccataaaacaaaaaaatactgatgttgtaaggatgaagtacatcgccacccctcctccttcatggacatccactgagtgcttgttccaagtgctttcagtgcattttctcatttcatcccacaacacccctggatgaagggacgactgtttcattttagagatgaggcccggagaggagctgacttgctaaagtttcattacaagtaaggaaaagccagggtccacacaggctgtctggctccagagccactgttcctaaaattgtgacaactagggaagtggctgatatgcagcacctggcactcatgctgggaggtgacagctggaaggagcaccttaaggttgtctagtgcaagctcttctattccatagatgggtgaactgaggctcagagatggaaagtgtcttgcccaagatcacacggctcatcagtgagagtgacaggaccagaagtcaggtctctcatctcccagtccaaggacccctcaccaaaccctcttcactgagaccctcagcagctccagagatgagatgtccccggggagagctttatcacaagtgttttctgtagaagtatgaacccacaaatcaaaggccccaaaacgatgaagccagaagtcagctccatgcttatctccctcaaatgtgacaagaacatcgtctcacctgcagggtcagcgtgatggtgagggtcccaaagaagaggcccatgagcccaaagccaccaatgaggaggggtctccgtcccaggtgctcaatgaccaaaccctagtccagggtaaaagagagagagagagctattattccatttctaaccacaacaggggaatgtggcactgggaaccggcaatggcatcatgattaaaaaccggctttgaccctgagacagttgggccaccttctttatggccacagccctgaagcaatgctctttatgagaaaggaaaaagcgagggagagaaagtcacaattcttgagcacctacagcattaataacgagcactctcctccgaatcttccttgctatggtggactcctccaacagggagtctgggagaaggaactggatggatatggtcaccacagcccttctcctccttcagaggcaacctgcatggaaggtgactcctctgtgtctccatgttgtgggtttcataggggtaggcatccacagcggggcacaggggtgggagtaggcagagaagcccatgtcgttttccagtctgcctgtgtctggggaagtcaatttcattgtgggatgtgatgtggggagtccctggggaagtccctaaagctgtgtcctcgaagccagcttccctcggcctaggactgtcactgacctccatctggctggcccctgtgccccttgtccacttggtcaggaaacagctcctcaactgccaatgactgaaagagtaattgtagccgaatgtcagagacaggaaaacctgggtttatattccggctttactattttccagatgcacgaactttggcatgtcacttcacttcccaaagccccagggcctttatctgtgacaagagaatcaaaatatccttccacaagagtgtctggagtggaagggtgtgttaaataagagactgcactcaacacacaggttaggtactcggattatgtgaggtatcctcctctcatgctccatatcacaaaaagagaacacggagggtcagagaggtgagataacagcagacatcacagagcaagtaggtgagagagggccagaaattgagcccagaatgaatcagaatccatggcttttctcaatgaggcaatcaggcgaggcttcctggaggaggcaggagcagacagagatgtggagagcttgtcaggcagagggattagtgggggaaaaggttttggggctggatggtccccatcacgacagtcatttggcttggacaaggggaagcagtgacgctgctgagggccatgaagccagagcacacatggctcctgcctgccagcttcaggtgacagtgcgaaggtcacagcactgagacgaacagttgcaatccttccccaaagcctcagggtttctccacaatggaacccagctgcagggaccccagtgccctctacctgttcctctttcctcataccctgctccttagagggaggcaggtgagaagccgtctaggcaatgggcgttctcccccaagcttagcatgggctgttgttctgctgggcagagccggcactgaggggtgagtgacagctgcctgtccgaagggcatagccctgtgggtcagctgagcaccccggccatgtagtgctgcctggggccatggacctctcagtcacctgggcatgaatgttgaggggaacggagggtgctggccccgaaagtcagaggcctgggaggaaaatgtgcctggctgatgaccacatgtctctaaaagcatccaagacttctggtcagaaatgcctttctcctgggtgcttagggaagaagggcagactcaagcctttaaacttggcctcctagaaacctggcccagtggaacagagcacaggtgacatccaggggcacaaaagcctgaagatgggccatctgagctgaattcctggctttgccacttagccttctttgcacccaggacaggttattcagcttttccaagtctcagtttccccacctggaaaatgagaatgataataccatttttgcagggtagctgtgagataaagcgaaagaactcacaatgcctgaaatagactcatgaacaaaagaggttgccaataaatggcaggaaatatattattcattttaactaaggagtgccctggggatctggtcccaactcttacccgtagctggctgtgtggccttgaacaagttaattaacccttccatgtcttaatttctcatcttttctgatgataatggagttagtctagataccaatagctaatgatcatttactgagcacctactatgtgccaagcactgtattaagcacttttcatgcagcaactcatttaatcctgacaataattttgagtaggttctattatttgctccattttacaggtaaaagaacagaggcacagagtctttggaaacttgtccagggtcacatggctggtaagtggcaaagctgggatcacctacaaaatcttttctgttgttgtgacattacattttcttgacattaaactagaaacagtcaatgccaccacttggtaacagcccagtgtctcacctggtccagctcccggacccgaacaagggcactgatcacttttctgcccccccaccccctcccccctccgcattcctggctctctgattctctttcttcacttgaaggctaggagccttcatctttgctttcccagagcctggaagaatacctgacaggtgtggcgtaagtgtttgctgagggagggaaggtctgtctttataacgcaggcagaatgattctcatttgcagggggagggcggggagggcagtgaggttcaagaatactgagggacagtaacttcacttggtgggaagtggggagggaagtcaggcccagtgagagtcaggagggaagcaatgaccaacagcttctgagaaagagagatagggggaggcagagagggacggagggagagaatgagggagggagggagggagtgagggagggagggagacacagagaaacctgcatttaaagcatcccttcctcttaggccctcatgagctgggtttcatcaaagaggagacactgatggggctgctgtgccaggtccagtgcaacatgggcaagggagctgggtcctagtgccaggagggacccccgcaaaggtaataggagaaaaggcccagagatatcaggggcttagagagattatgaaattatgggcccagagagattatgcttatctctgtgtaactcatactaatttcagtgtaacaatgcaacacatgttaatctcagcgcaacacatgttaatcttggcgtagcactctcagtgatctgggcccaggatcagaggccaagagtgattatgggatttaccaaaagtcacccagggctaactattcagagagaaggaagtgggatagatgctgttttacaccaaggggcagttgcaaacgtccacacccttggactcagtcactcaccttctgggcattgatcctaaggaaatagatgtttggtcaaagatgcatggacaacgatctttgttggtgtgttatttatactactggggaaatagaaataatctagaaatccaccaacaattagttaaataaatgctggaatatctagatggtaaatatgtagaaattaacatagtttaaagaattgtaaaatggtacagaaaaattctcagggtacaatcttaggcgaaaagagtaggacataaatctgtatatactaaaacatgtagttatataatatcaattacaattatgttaagctaatacaccctggaaaaatatatgcagaaatagtttataatggctaactctggttgggggaatatgtgattattattttatttgtctgtcagttttcctgattttctccggagagttttgacttaaaaacaccaaaaagtagatttagttgaagtgttggatgcaaatctctgtcccctgtattatgtctttattctttccaaatcaccaaatatttccaatacccatactggcaatttttcataactgtgtaaaatatggttttggtacaatctaaagatgtcacagcttttcttgtggctaacaggacagagccaaaagttaagctgttgctgaaaatgaaggttgttcataactggaatatgcaggaactctgtctcctaagcttcttaggggagttggattagagtatccagtgacctggtgctgaaatgacaacagaatgtgccatggaagagcatcacagttgctgggagatattattacactgcaatcagcatgtgttacattgtcatagggagatcagcacatgttacattgttataatgagattaatatgtgttatattgttacactaagcttatcatgtgttacattgttttacggaaattaacatatatgtttactgatttcagtattttgaagtttttaaaaaagagtttcaagtgcaccacccacaatttcagagtcagaaagtgtgcttacaaaagtcagttgagaaccattatcttacaccatgatgctgacgttcaaatactttggaaagggtggggtgagggacatgtggctttttgtttcgtttccctaaagtctcttgatgaaccagtaacttgagccaatgaaaggctgaacacattctccctgattcagaaatgatctttaaagatggtctaggaagacaccagggaaacagctttgaaagagaaagaagggataaaaacaaccctcccatctgacaatcagtctcccggctctgttcttcttccctccctcctttaagtccagttaaagtgcagcctgttggaagggattagagcgaacgtggtatttccacttgacattaaaatcatgagtgaagacattaactcagacgaacagcagactgaaggctactgatgtcagctagggatgactgtcaaaatcctaatgctcccaggaaacccctctggggactctggagccatggggtcacccatccactcagcagccattcacccagcacccagtgcccttccccacagggctgggacctctggtgaaataataatgggaaccttttgttctggttaggattttaagaagcagctttataaaggtgtagttttcattcagtctaatgtacccatttgaattgcacagtcttgtatgttttgacaaatgtatataccttataaccacaactacaattaggatattgaacatttccatcacttcccagaattatcttgtgtctcttcccccaactccaggcaacctccgatctgctttccagcacaaggattcgatttatcatttcatattgcttattgcagtgtttttgagattcatccttcttgtagtacatatcaacagttcttttgtattgctgatcagtattccattgcatggatataccaaaatttgtttctccattcacctgttgacccaatagctgtttccaattttcagctctgagaaataaaaccattatgattattgagtcttcatgtagacttgtgcattgatttctcttgggtaaatatgtataagtggaatgactgagttggatgggtaaaacctttataagaaactgctaaaatgttatctgaaggggttgtgccattttatgttcccaccagcagtggatgagccttcctgttactccacatccttggcaacacgtggtattatatcaaccatttaaatttttgtcaccattttggtgaacaatggtatctcactgttggttttagttttaatttccctggtgacagtaacaatgttgaagatcttttcatgtgatttttgatgttttggaactcttctttggtaaagcatgtgttcatatattttgctcattttcaagtgggcagttggtcttatttttgagttttaagagttctttatgtattctgaattcacgtcccctctcaaatgtgttttataggtatgttctccatgtctgtgacttacctttttatctccttaacaataccttttaaatagtcacagtttttaattttgatgaaatccaatgtatcatttgaaaaatggtttgtgattctgtatctttcctatcctaatgttgcaaaactttctcctttgcttctagaagttttagagtttagcttttatgtctagatacgtggtccattttgagttaattttttgtatggtataataagggttgccattcacatttttccatgtggatatctactttttatgacactacttgttgaaaagactatcctttcctcattgaattacttcagcaactttttgttttctggattccattctgttccattgatctgtggggctgcccttatgccaatctcatgctgtctttattcccatgtttgaacattgttacaatccttgctatgtaccaggaatggttccggctgctttatatatattaataacttaactctgattacattttcttggggtaggtgctgttatcatccactattatatccagaacttgaggctcagagaggtttagcaacctggctaaggttgcacagtgagtcagaattcaagtctaggcactccggctccagagtcttgctcttaacctttgtgttctacttcctctccccagtgtttctgaggcaaatacacattcacatttatcaaaagaatatgcacatgctcccaaagtttttctcccttcatttgtgtgagctgcctgaggtcactgagagcctccaacagcactggcactggggcacagagaagacagagccaggagtctctgcccttggggagctttatgggctgaattgcattctctcaaaaaaggaaatattggaatcctaatctcctattccctagaatgtgaccttgtttgggaatggggtctttatttttaggtgattcagttaaaaaaatgtgaccttgtttgggaatagggtctttatttttaggtgattcagttaaaatgacatcatttggatgggcctcaatccatgatgactggtgtccttgagccaatggaaaagggaaagtgtggacacggagacagacacgcacacaggcctgtaatcccagcactttgggaggccaaaatgggtggattacttgaggtcaggagttcgagaccagcctggccaacatgatgaaaccctgtctctactaaaaaaaatacaaaaagtagccaggtgtggtggtgcatgcctgtaatcgcagctacacgggaggctgaggcaggagggaggttgaatcgctggaactgggatgcaaaggttgcagtgagctgagattgtgctactgcattccagcctgggtgacagagtgagacattccacctcagaaaaaccaaaaacaaaaaaagacatacacagacagaatgtcatctgaagatgaggcaggggttgggatgatgcttctgccaactaagaaacacccaagatcacctgtaagttcctggaagctgggagagaggcacgggacattctccctcacagccctcaggagaagtgagcactgctgatgctttgctctcaggcttctggccttgagaactgtgatacaataaattcctgttgtttaagccacgtagtttgtggcacattgttttggcagcctgggcaaaccaacacaaggagctaacacctgatggagggcagggcttgtaatgttgcctgctaaatgattgaatgtatgtaaaaaaaagaaggaaggtagtctccaaatatgtacaactattatatgacaataaacaacattttaaaaaggaagagctggagggcaagaaaatatcgcctaaaatttaatttatttcaaatttatctcaattaaagcgtccaaatttgatgtaatgtgctttcatattatttcacatacattactttatatacactttatttattgctcattgtctatattgtattcaatgtgtatatctctctatataaactgcatgcggtactccgtgcatggcaggagttcctgactttctcagggactacagcgtcctacatgagttcttccctgtgccagggtgagccttttggtcgtagaagatgccccattctctgtgtccaactccaggccggggcctttttaaattcttctgatttacataatccccatccttgcctggcttgatgcttctgggtctgtgggccgtgtggactgattgtgcgcaggggccctagaagcctaccaggaggaagccctgttggttgggctctgcctccctcaggacgtcctgtctgactgctccctgcagggatcccagccaaaggcaagagctccctctttagtcagctggtgtgatttcctcaacaggctttactagagccgtactccgttgagcaaccattaatggtattgaatgcatgacaactactatggccatttctttaaacatgatgcatgacacacactctctctctccctccctccccctctctctctctctttctctctttcaaatttacattttaaagcaactctatgaggtttcccctaataactcagccaaagcggtgcagacaactgagactctttcagagagaaatgtaaatgctggggcaagatgtggcccagatgagggccaccccgcaggcatcccaaacagctgtttcctaatcctgacatgttggaatggaggagtacctgaggaacccttggcacatgagcaattggtgactttctagtcagaagttggattattgtcaaagttttagctgcaaaaggatgggagaaaggagcagagaatggtgtgattatcactgacgcagctccctctgcagagaacagaaggccaaggtacattacatgaaaagcaatttcacattccagtattacttttagctgctggtaatcctgttttaaacatgcaaaggctaatctttactttcacagatctctctaaaaagaagccaagaccttggaaagctgtggttattgcaagttagtgaaattttaaaatttatgttcagaggacagagtgccagaaacaattttctgcttgggacaggctctctctaagttaaaaacggaatataattcaatgaaacaaacttttttgggaatttctgcttaaaagatgaatgtgcataaaaggtatcggtgtatctgtttgggccaaaggtgtgagaaatgagagttgtgttttaaataatgatcatcccagggtggcccatgatctctaagtataacaaattaaaatgtcttgagatatttcagccaaagtgcaaaacagacatgggttttccttccatcccatgccaactgggatggaaggaaaggctggcagcagacaggcttttccaagttctccagtcctgtggacgtctcctccacttgggtcactttacaagcttggcttgaggccgtagcttctgcagtttctaagtgaagcactccccctcatgctcttactcttctcaaaaaaggcaaaatgtggttctcaacaggtttgtgaggatacattcatattgttcttggaaatttgggcaagtagaaaaaaaaatagctcttcaaggagcagagaaagagacactggatgtccagatgacttaggagtcagggcttccatagcaggagcatcgagttggcagagggcagtgggcagtgggaacagccgccacttagaactgacacaaggggatggtaaatgctgtctccaccctgcatcccatgagccacatccgcactttcctttggtgagtgaagctggtggggccggacacaggggagccaaaggatgttatcagagggatggggagtaaatcaggaaaatttggtgggaagtaaagactcaggagcacatcccaagagtcagagggtgagctgcaggaacggacttgtgggtatgtccttggccaaactcaaaaatagagctacttacttaaaagatattattcagagcttggggtgggtgggagtggaaactgcaggggaatgtgcttccagggcaaaaccccaccttttctgcttggggatgctggggcactgactctgtttcttcccttcctcatccccacccagtcctcaccccatgaggataacctgtcataaccagaagtattagttcattctcatgctgctataaagaactgccgaagactgggtagtttacaaaggaaagaggtttaattgacaaagttccacagggcgggggaggcctcaggaaacttacaatcatggtggaaggggaagcaaactcatccttcttcatgtggtggcaggaaggagaatgagtgtccagtgaagggggaagtcccttataaaaccatcagctctcatgagaactcactcactatcatgagaacagcatgagggtaactgctcctatgattcaattacctcccaccggtccctcccatgacacatggggattgtgggaactataattcaaggtgagatttgggtggggacacagagccaaaccatatcaacgagagtccacatttctctgcctgcttcctgctcaggcaatggtaacactaatgcttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgttaaataaactggggacttgatctagtattttagtggaggaagggtgtagtttcttctagtctgtgacctatagaaatgccatagaatcattatttatcaatgaaaaaggaatgtctgtcaagggaaattaattgaactcagtcctttcgaggccagttctagagcacatgtcagtgtgatgattcacagggaaaaccggcctctctccaagccttgtgacaacgctgtttctacccttgtcaccctctgccattatctattttgtctacagcagtcagagggatttaaagcatgacctggcactctccttttaacacccctgtccactaaaagccttatagacagcaaagaaaacaatcaacagagtgaagagaaaacctacaaaatgggagaaaagatttgcaaaccatatttgaatcccctcaagccccatgcccccccaccagccccttggcccctcaagcggcagccacatccttgcccctgccttgggctgctgcagacatccctgtcacctctcagattcttgctgtctgtcctagagggagacccattggctcaaatcaacaagctccctgccctctgacctctaggcggcttcagcagaaatcagaaatcagaggtcagaaatcagaaggcaaaagaaagagaatgaggccaggggttggtttcttggttcactttctacagagacattttgcctggctttgtccctctatcaaaggttgcagctcctgataggtggcgtacccaccctacatgccctcggctgccctgaattaatctgccttcgagctgctcaggttcactgtgtccctctttcccaaaggtttttctttcagcagcttcttttgcctgacatgctcttcccagacagctgggctcacctggagcctgaccacaatatttaaaatggcaactgcccccgtctctccattcccctttctctgctctactgttttctcataacatccttcaccttctaaaacactgtgtggggtactcccttgttacactgtctgtgaccccatgaggagctctccttctccacagcagagacctttgtctgttttgtccactggcacagagcaggggcccaagtgagcacttgctgagtgctggaggaagaagcatcctggccttgggctcgtcttctagtctttgagaggtagcagggcagcttcggcattttccatgtctgcttctcttcaggaatattaataacaagagtaactgcgtgagtttcccagggctgccgtgataaggtcccacagacagagcggcttcagcaatagaaacgtgttgtctcacagttctggaggctggaagtccaagatcaaagtgtctgcagggccctgcctctggaggcgccagggaagggtctgttgcagggccctctcctggcttctagtgtgttttggctttcagcagcacaattctaatttttagagggcgttctgcctgtgtgtatgcctgcatctaaattttcccttttcataaggacagtcgtattggattaggggcccaccctattccagtataaccgtatcttaccttaactaattacaactgcaatgatcctatttccaattcaagtcacattccgaggtactagggacttcaacacatgcattttgaggaggtgcaattcaacccataacaatagtgaacatttattgagtatgttctctatgccaagcactgtgaattacagtatgattcccatgacaatacctgctgaggcttagatctgttattattgccactttcactaagagaaaaatgggtatcagagaggttaagtgactagctcaaggtcacccagctagcagctgcggggccagtatgaaacagagcccagatgatctatcaccctgctttctcccttttaccacgttctgctctcacacgggctggatccagtgtcctgagttccagcagtaaactctgaggcctttgattctgaaattgtcgaatttattgggaagcaatggagactacaggcaacagaaaccataaggattttttttttttttactacaagtcaagagcatattccattcttgctaattatgaaaatgtactgcagtgaatcagaatgacttcctgtgaattctgacccctgatttgtaaaagcacagagtctgtgcttctcaagagtgagccctcaccccacaaagctcctgccccacatggcctgaatgacgctcactggaagttcactcatcagagagttaacactgtgccaggcaaatcaatttggaaaaccagctgtttctgaaagatggcgattatttacagttccccaagctgatgactgacgccctgagccaaaattaattgcagatcaaatgagcaaagatgtctttcccctctcaactttattagcctcctgagccattttaatagactgtcaaaatctcataagaggaatgaaaaaaattggaaagtctttttggataagcaatcacttcaaagggctggatgaaatatatagacatatatttgtgtgtttattacatatgtaactgtatatatataaatatatttattgccttcttttcaaatatatttcaagatatataatatattttgtatattatataaatatataaaatatattttatatattataaattttatatatttatatattttatatcaataaatatataaaatatatctacatattttatttccttgttttcaaatacataatatataaacattataatatattatgcatattatatatataacctatataaatatgatatttttatatatacataactttggaaagtgcaaggaacttaccttatattgatgctctgtgaggaacaggggagtggctttcacacactttggattttgtttccataattctgtcagatgctgtattagtttcctattgctgctgtagcgagttaccacagactcagtggcttaaaacaacccaggtggattatcttatagttttggaaatcagaagtctagaatagatcttgcagtgcaaacacgatggtgtctgcagggctggttccttctggaggctccagggcagaatcttgcctgctgcagcttctagagaacatctgcattcctgggcgtgtgaccccttcctcaccttcaaagctggcaatggcgtcactcctgcctctgcttccaccatcacatctccttctctgactctgaccctcctgcctccccctttcacttacaaggaccctgtgataatattgggctcacctgggtaatccagggttagctccctatctcaagattagtcccacctgcaacattcctttgtgccatgtaaggtaatatattcccagcttctgggaatcatggtgtggacatcttggggagccattgttttgcctaccacaggtgggaatggttatgtccattttacagatgagcaaataaattcagatgtgttgggcaatgttcccaagaccacttagctggtaaatgggtgatcaggatttgaattcagagtagcctcatcctaaagccaaagctgtttctccccagaacatttttctattccacactctcaacctcatgctgaatttagtttcatgcctttccaggaattggggtcaatgctaccattttaaggactgtttccaatggactattctgcatccatccttgcatctccagctctttgagaagatgaaagggggacagactacccaatgcacttcacttcacctaacttctgctggcccttcagctctcaggttcctggtccctgtctccaggaatccctcccagaaccccttatttgagagggaagctcgtctcagtgttgcatgtggtaattgtttccaggtttgcttttctctctagatcacggcaacgtcacctgtgacagctggcacagtatgagtgcaccttaggtgtctgtggaatggatgaatgcatgcctgcatgaaagaatccaccacccaagctctgaatcatcacttcctgctcagaggaacctcccacacagagattcctgcacctctagaacagcaaaacatcatttatccttgggtcatagtcaacctcctccattggactgtgagctcctacaggcaggcaccatggcaaaggccctctgtaagcccagcacagggccaacagcctgaccatgggaggagctggcaagagcttgctaaatggcggggtaccaactggccatggtccagatgactgagatccactgggtccaaacttaaaggcagtggcaggagtgctctccagaggctgagactctgagttctgattttagaaaggactcttccttcccttccaggactgtgaagtcatttaccctcctttctggggtttccaaggaatactttgcccaaaattgtcagcttttaaggaagatgatctgcctgccagagcatcgggatgagaaggagtggcttctggagtctggaatgaataagaatggcttcccgtgaagtcttcttgcaccaagggaagaagtgtagccacttcctcagtgtgcccctctttcaaacaatggcagtcattggactttcaggcatgatgtgagcattcatgaggtcccatgtagaacactttggggtgtcggtggcagggacagtaggggccccatgatgttctctttccccactctcttgggttctgagccagctgactgtgtgacccagagtaagtcactccttttggtcttagtttcctcaactgtcaaaagatagcaagaccccctgtaaaatcctgctctccacaaggatgtccatcgtagccttatgtaaaatcacacattatggaaatctacctaaataggacaagaatagttaccacttactgggtgtataccatttgccagccactgctggaatcacttaatgtatattcattggtacaatcctcagcccatccctatgaagcagggatgatggcttttagaagtggggaaactgagtcacagagatgctgaataacttacttgggggtcacgcggctaataaaaagacacagagctgggactggaacccagaaagcatggcactgccatcaggttccgagcagagacattcaacaacctcacccgcagacaatggttaaggaaattatcatacagaaaattactggagaaggataaatcgttcagcactagtgttaattcagggaaggtgatgatctacatgattttctgcatatatgatacacttcaacaaaaaaataataaataagaaaatggagagtcattctgacataagattatgtgaacaaaagcagatcagagctcgtatttagaataggattactgtgctactatgtaagaaatatacatctatgcatagaaagacaagggaagaatttgccaaacttccttgggtagtatgattgtaggtaatttcttctttgttcctctctatttttccgaattttacaaatttgccctaatgagctggtattgatttcttcacaacaccaataaaatactttacaaaaaacaaaaaacatctcccgtacttcccccataagtttcatctcagactgtgtttttccattgctcaaagtaaaaataaataaacaaaactgggtgcagtctataacttgagaataacaagaatgaatcttgtgaaacttccagaatgtgaaacgttgaaatgttttcttctaataaaaagaccacaaagtggaaagggaaagagacaaaacatcattcctctacattttttatggtatctattttttaaaagcatcttgttagaatgacccattaagtgcaaggtacaaaatgaaatgttctgtcaacaagaagtcagaaagacaattgcaagcctctgcctgtttgcatgggcatcaatcttgtcagtgcaaatcagtgagcaagagtgaaaataaatgaactactccatcaaggtcagagaatataactctctaattttagccctctctttccatttggaagggagcctaactgtgtgctgtgtgcccaaaatgtgaggcacagacatagctacaaaaaagaagagacacaagcatttcataaagaggacaactgaagctcagagatgttgagtgcactgctcagtgctacacagccaagaagtgccggagccaggattcaaatccagtttgatctgattccaagatctggaaatttctactaggttctgaagccacccaactttcccctccaccagatgtttgttttgcatattggaggttgagaaacagtgaggagctctatgccttcttttgaacatattggcttattattaaggtcttcctctctattatactggtcaactgaatgtcctttctcctttgccttgcaaactcccacatgtctggggtaatgagatgactgctaatggttttgaaacattttaaatgtcatggtaagagattggagattcaagccaattctctgatccgaactcctggggacaatatggccctgtttcacagggcattcatatttcatcatttgtgactaggtgagaattcaaaggatggagttatttattaaaaggaagatgacagggaagcaaaatctaggaaggaaatattctctagatgggtaaaatgtcagtgaagaatattctctagatgggtaaaatgtcagtgaagagctgcatgatgacctcctaaaatccagccccctttggcatgataaaggacatgctcctctaaagagatgcctgtttgttgccttaggttcccacattgcagtgttgcctgccccggaggtgtcaggaactgggtgagaattgtcgctcttcagtacccactttgaggttttgggtcaatagcccagacacaaatgatgtctgggttctccccatcccagctatttctttaaaaccaagagtttgctgaatgataggaaaccacattgtcctaattgatgaattctgatggggaaagcctgtgccttaaaggaccttatgaacattcccactgtgctgtgtaaccccctgtggcattctcaggagtaaccctcagttgacttacagagaagacggcagccaaagtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagatagaaacagtaatgttggtggggcttccaggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccatcgtaactttatgagaaccagaaaaggtccccactacacaaaacgctttactgtcatccactgaaaaattgccatagtaaatccacaatgcatacaaggtgaaagatgttccccagagttgggtaatgcacaacctgtttaactatacatagagcccctgccttgggataaaagccacttgtttagatgctggaccaggaagttagaaagagttagcctgtgcccttactgactacactggttctgtaatttattatccaaacatgaggacttttgagagtgttgataattatgctaggatgacacacttacattgagtgtgtcctgggaaaaccaggatgtgtggtcttggagttgctataccagccctcgcaacttatttcatgtgagactgaaaaccttccatcttgttgaggtctctgttggggtacctgccacatgaggttagacctaaatcctaattgatgcccatggcatcagacaagaactgattaggagtttggagacctggctccatcttgaactagctgtgtgacctcaggcaattcaccctgccatgaggagattcctactcctccccagtcaaatgaacatgaccatgcttattttgcctgtcccatgaggtgtcaggaactgggtgagaattgtcactcttcagtattcactttgaggattttagcctggacacaaatgatgtctgggttctccccatcccagccatttctttaaaaccaagagtttgctgaatgatagaaaaccacattgtcctaactgatgaattctgatggggacaccccctgcattaaaggaccttatgaacatttatgaacagtttgatacttattcagcagaagtgttagagcacattgctcataacctgtcaggtccaacgttagctggccacactctcgcattttgctctttgtttctggatgaagctcttgtttctatagatctgttttattgccagatgtttttagcaaaaattattcatgcattggggggaagatataggacctacttatatctacagatggttaaattttgtgaagaaagtaaacctccataaagttatgggcataccaagagatgccagtgaaaactacgacacccatttcttcgagcttgcaggcatggatacatccatctattggcaaaaacaggttttaatattcgtgtaaaacaagaaccttcatgttctgcacctgtttctcacttgagtgaacgttagactccatcgttagcctgaacctttgctgtcacatccatggtgtacagaggtagtgcctaataaatccactaattcctattgttctcagggctgtgacagaagctgacattataacattatcctgaaaactctatgtccattgaatatgtttatacaattgcttcccctttagaaggtaactatgatccccagtgcaccgtcagggttggattccagaagtgtaacagcctttcttaatcatcagccaaattcactgattttcaatggccaacgttctctagggaccctcttaatgccctcaggctgccaggctgtcacccatgtgaaggtgtctgacatttgtgttattcacagccgtggttctgatccccatggcctgaccagctcatggtcctgaggctcccagccctaggtcccacttaatgtgaatcctcttatgatgtggccagcacctccttctggctcctctcacccctcacaaccccgtcttccctggtttcaattctccccatagagacactgctatagatgtcccttagtaggttagtgaagagagtcattgtacataaaattctaagttcagtgagggacagttataacttttgcagggaaattgatgaagctggaaaccatcattctcagcaaactaacataagaacagaaaaccaaacaccacatgttctcactcataagtggaagttgaacaatgagaatacatggaaacagagaggggaacatcatacaccagggcctgttggggtgtgggggggctagaggagggatggcattaggagaaatatccaatgcagatgacaggttgatgggtgcagcaaaccatcatggcacgtgtatacctatgtaacaaacctgcacattctccacaggtatcccagaacttaaagtataataataataataataaagcaataaaagccatatttagtcttatattcattcatgcaccaaaaggcagaaatcagtccacagatcctctcccgctgcccaggggctacaggggtcctgccgggctggccctgtctgccccggggcagacctgtacatcacacacactgccagtcttaatctgtttgtgacacgaagccactgccctccccctacatcagctgatagagtgggaaggtgactgccttcagctttacctctgctcacactgaagcttatttgattggacagtttgagttcactgtaaaataagaaagcactcaggaaacttaagagtgcatcctgccccggagccccgccagcccccacggtgtgtgctttgtgttgaccttgttcaccacacaactctgttctcgcaggttgcccctagcctccccgtgcagcgtggcaggagcagcagttctggaggcatagagtggggattctagccccagcactgtctctcatgacctgcgtgaccgcaggcaagcgattttgcatctcggaatctctgttctccaaagaaaggtaataatacttcgtctttcagggttcttgtaaaaattttaatgatgataaaagaaatcatccaggacagcacctgttataattggcatataacaaattgtaggtatcattctagaaggttctgtctctccatggagatgtgattgcttcttggttaagaagagcatctggaaccaacccaaatgtccaacaatgatagactggatgaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccgcatattctcactcataggtgggaattgaacaataagaacacatggacacaggaaggggaatatcacacaccagtgactgttctggggtggggggagcggggagggagagcattaggagatatacctaatgttaaatgacaagttaatgggtgcagcacaccaacatggcacatgtatacatatgtaacaaacctgcacgttgtgcacatgtaccctaaaacttaaagtataataataataaaaaaaaaagaaaagaagagcatctgacagtggcacatatgccatgctaggaatgcacctctgggtctcttttcagcctccttcttgtgggatggggctttgaagaactgtgcagctggcaggtgtgggggtaagggcagcaggaaagaatttgggtcttctcaagtccctgcccttaatgccctgaagctctcattcttaactcacgtcatagtgttttagagacaaagtgtaacatacataatcatttttgccccctccacagttgggcatgcctaaggatgcccaacatgtctaagaaagcagcatgtctaaggatcagtcaagggtccataagagtaaacatcccatttacttttgcctagaacaaggtgatactgacaaagagtatgggtttaatttatgctttctggatgtggtgagcagaacaacagccccccgctctcaaaatgttcacatgctaatcctgggaaccccagaacatcttactttacatggccaaagggactttgcagatatgttaagttcagaatcttgacatggggaagttatcctggattatctgggtgagctgtaaatgtaatcaccagggtccttaaagagggagtcaggaggatcagattcagagagaagacgtaaggatggaagcagaggtcagagaggaagaaatatttgaaaatgccatgctgctgacttgcagatgcagaaaggggccacaagccgagagatgcaggtgccatctagaagttgggaatgtcaaggaagtggatgatccctctggagtctccagaaggaatgtggccttgccaacaccttgattttaggacttctggcctccagaattgtaagataataaattggtgtggttttaagccaccatgtgggtggggctccttcaacaaaataatagctaagctattgcagtaatttgctacagaagcaatagaaaactaatatatactggataaagatataattaatatattttatgcatttcctgtgtgtttgtgtgtgtgtgtgtgtgtgtgtgtgtgagagagagagagagagagagagagacagagagagagagaaacagatagagagagataaagagagaaacagagagagttgtaaacacagaggtggccgccacagacaaatggtgatgtataggatctatcttgaagtacagaagacagagaagaccttgcccatttattaaacactgtgttccaggaactgtgccgatgcctcacctactgtttccagggacctcctttcccttctatttcctgtttccatttggggagcatccactagggaacatacctccctctcaacccaagggacagggaggtagggagtgccctcttgcatcccctgggctctttctgtatctgcctcctgcaggaagctggagatgtgtctgctgcctccacccaaggaggggcttgccctgtagaggggtctggggttgctccttctgcctgtggctgggtctagcatcttaaagctagaggtgctgaactaactgccacttatgaagccatgctgtctaatccagctccactcaaaatagagctaacattttcatccccatctggttcttgtgcctctctctgtctccccctctctaaccttttctgaatttcagagaagaagggggcttatctattgtaaatccccaaacctatcccctacatgacgtaactgcattcccagcacagcccagtgagggagctatcactgctccatttaacagatgtgaaactgaggctcagccaggtaagggtgacccagctatgagtggcagagctgagatcgagccctgatcatcccaaacatttctactgtcctctgctacctctgggtgagaaggaatctgttttccttccagagatgctaggggagggtgctaagtcctatggagcagggcaagtggaattacccgagaggtgagaggaaatgggagcaccagggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacaggacctgtgggtcactcactggccttgaagggttagctgggcttgaagctctggtccctggtggttgaatctccaaggcagggcaattgaccatctaacgtcccctctctgtgagctcctattcttgggagggacgggagtctgtgggctggacagaagggatttgaccccagcaattgctatggtggtgagaacgtgaatgcagatttcaaccaccccggccttgctttatatccttagagcacatgtgagcatgaaactggacagcatatctagatgcccaacagccggtccatgctcagtaaaaggctgcttccttctctgacctccactgtctttctttataaaaatccagaagcatacaaagtaaggactcaaattttaagagtggccagaaaatgcttgcttttaaaagcttttctaagagtgttggatcacccagtcttgcttctcatcttacggataaaaatctaacctcacactgacctagccattagcccaatgaatgataccacctttctggcctggtcttctttgaactctgacatgagtgattgaggctcagaggggtgaagtgtctcacccaggactacacagctgggaagtcagaggatgtgggctggaaccatagcctccctggtggtctcagtgtggggctccttcaacaaaataatagctaagattatggagcaccacctatgtgaatgaccccatgctgaacttatttatttgagacggagtttcgctcttgttgcccaggctggagtgcaatggtgcgatctcagctcattgcaacctctgcctcctgggttcaagtgattctcctgcctcagcctcctgagtatctgggattacaggcatgtgccaccacgtccagctaattttctatttttagtagagacttgtttctccatgttggtcaggctgatcttgaactcccgacctcaagtgatctgcccaccccaggctcccaaagtgctgggattacaggtgtgagccaccatgcccagctgctgaactttaaatgcatcctttcatctatcttcaccaccactctacagctggggaaactgaggcacggaggagtcatgacaacttgtccaagatcccataactcaaaagttcaatgttgcaagctgcatgcaggcagatgaccccaagcctggcactcttgaccacagttcagggtggccatatggagggtctcttctcagctttctccctgttcatcaggacatagcaaactgctgcagtgagatggtctccacttttatgattacagagcattttagattcttccaacttgatctaggaagtgatttcaggagaatcttttcaaaaccaaagttattaataactgcttctgaaattataatttgagactttgtacaaaacttgatttgggctccagaactcctaatgatggttcaacaaatcagatggaccttcatgtggttccaggccaaaagagggggaaagtaccacagttttctgtaaacacatctaaagttttcatgtctccttccccttgttcctcccagtcacctcccttccctcccttctactcaactgtttagagaaagcgtaagaaatctgggactctcttaggcactaaggtgacagcagacaacacaggtcctcgtctaccctagaagacctcttagtctagcaaggaagggaggagtacacaacgatttcccaactaagtggttagaggaacacaccaggaaccctgtaatgcatgggtatcccaccaagtgcaaagacccaggcagcagtccaccgccggtgagcacccagaaccaatgtcaccaggcccatatggctcattcacagctggcactctgatcctctttgctcttcttttacatctatttctaacacacttgggtgtcttgtttcccaaccaagactgcatatcaggaagcagcagattttgaaactgcatggcattgagagaggagaaaacaatgctagaaacagtcgtgctgatgacagcaaggttgggaggagattcatgcaagctgagcagctgccacctgtgagatattttacataattccacagattcctcacagcagttgtgcaaactgagtattatcatccccatttttcaggatgggagactgaagcccagggaagtgactatgattggcttctgtgtttaagaaagaaggaatcccaaggaaggaagggtcatcccaagtagataagagaaccaccatgaccctgggcattctggaagataagggaaggttcaagaaaatgaaggcttccccacactgggcttgacaattggtattgatccaattttcagcccaagaactccctatctcctgccctcacctccttttctcccccagacactcaggtgcccaccatgtggcatgggctgctctggtgctggaggcacagggttgataagatgcagcctccatctcccaggatggagacccactaatagctctctccaggtgaggggagcacagtggaggggcaggaactgctgtggccaccccagcaatggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttatcccaacttttgaataatttcttttttcctttttttttttttttttttttttttgtgatggagtcttgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtgctgggattacaggcacaagacactgcacccagcaaaattttgagtgacttctaaagtacgtgaaaaacattcatcagctccttagcataaatatactgagccatctgtgatgtttgcttgatacagaggttctcagccaggggcaattttgctcccatgggatgtttggcagtgtctggagccatttttggttgtcacagctggtggggcagatggtgctactggtacctaatgggaagaggccagggaggctgctgaatagcctaggcacacagcacagcccccatgacaatgaattttccagctcaaaatgtacacagatatgaggctgagaaatgcaagtttggtacaaagtgtctgggtgggctgtccagggagtgcacccaacaccagcaggtgtgactttgtctgtgcaggcaccacccctgggaccttgggcaatgcctgaccctctgtgagtcacacgtccttcatctagaaaatggggacaataccacttaccctgtggggctgtttggggcttgaataaaatgacaaacacagagatgcctggcagtatttacggatgtctccagtgacatgtcatgtcccccaaataatgtctgggataatgaagaagacaaagcaagtcttccaaggcagctgaagttttggatcccaggggtggtgcctgcacagaaaaagtcacacctgctagtgctggtagctctctttgtcccgtgaatttggatgacaaggcagcaggtacaggggagagctggaccacagtgtggctgtgatgctggcatttgccactaaacagcatgggtctctctgtatgtaacacggaagaagacttgtccccatggctgcctagggatggcctggggacacagcctgagtgacatgcatgggggtgctctgagggggaccttggggccagatagctagggctcaaatccttttactattcctcactgtttgaccttggaaaagtttctttatgtctttaggcctaacagtgcggcctaactcacagggcagccatggggacagctcctggcccactctgagtgctacatgcatgtgcacttgatgaggtttgcagcccagtaggtggaggccaagtgacggggagcagctggcctgggtttctcactgcaggtttgtgtcccactgagatgggaagccaggcctctgactcttggtccagagctctgctccaggtcaggtaaagcacgctcagctggaaatattatcccgacttaaagattgaagatcatcaacatgggagggcagaacactctgaggatggggcctcatgactgctggctttgggagcagctgagattttttttcaacaggtgcttagtcagtgcggcttgcaggtacaccatagaggaatttatgaagttatacgggggatgcaaatggaaaaatgatgtccctgtggagaattgaattctgtttagaactgatggttctcagtgtaaatgcctcattcactacaggttccatattcggtctttaaggcttcaggtgttagcttgaagaaacaattcacttcccctctctactctctgagaacaagcagcgcctccttcagactgtctggcaaaacctcggtctcgtcaacaggaagagacaacaggactctcccaggatcactcagttaatgtaggtacagccactgacccaggcgcctgctcaatctgctgactttaaccagaccaaggagaaaggtaaaagcaagaagcaaggtgatctcatttcatcccagtgtttccgaaaatagaaccaacagttgttgaaaggaggtggaacaacactgtggttgtagatttctatgctgctgtttttccttctctggacaggaatgactccccttcacatcaccttccctagacacccccaaacaccctccctgcccgccttggggggtgctggtctcacgcttatttagtataaatgcaagctgtcttactggggccctttggaagggtgctggcgggtgccccttctccctctctctgggttcagtcagtctcctcccaagtgacatgagtgacctcagaggcagtttggatgctttatgcaagaatctcctctacgctcccctgccaagtggttggccagcctatttgcacacttccatagatggggagatcaccacccctagaggcaacccactccatttgtcagaagcaacagtaacagtaaagatccagactctgcctccctaagtctccaactgggaattccacctttgagtgccctcaagggagaggagactgctgtgaacatccaagcatctggggaacctcatggagagacctcctcagacttccctgcctgcagcagctcaagccccagaacatttcttacttaaagccttgaggtttttttcaagccaaagttgtgagttgaagacagcccagtcaagagtacttttatgaaaatcatctgaatgtctctcacttctgacttcctaatatcaattttttaaagaaatataacttttagacatgtctaggaataattagtgatagcatttattataggatatctctgtggctagcagctgaactgaacactttgcatggattgtgtctttccatattatgtgatcccattttacagatgaggaaactgaggatcagtcaagttacatggttacctaacagcatagagtttgtggcaatgacagaactgagatttgaacctgggcgtctggggcccaagccctgaacctccccaccctctgatccctccagtcatgcaaggatgcccaccgggccccaggactcactgcattgaggccacagagctggtagcaggccatggtgacaatcacggtgaccacctgccagcggacgtagggagctctcagcagctccagcacggacaccaggcggatgctcctctgcacgcggctctcagccaggacctcctctacctcttgggaaacgtctgctttacccaagaacgtttggaaggctgcaaacagaggcacacatggactttcagcagggattagagtgtccatcatgtctaatgctgggccctgcagggacgggtcccacctcctagccacacaccttagctgggggcggaacttggcaggggcctttgaaactatggagtccaaagcccttgtttaaaaatgggaaaacagaggcccagagagatgccatgatttgctcaacatcacccagctggctgggagaaaagctgagaacgtgggtctcttgactgtccgcaacgcaaggcagagcacacccagagttcaaacccgtctataacattgggcagttgtgtccctgttcatcttttgttatcattcctgcctccaatggctgttgtaataattgcatgatatcatatacattcaaccatggctcggagcttcccacactggagttcgtttgctgaatattcactaagcacctcctgtttgcctggctcatgagttcatcctcattgcaggtgtccggagaccagtaggatgtcacttggccaggatgccctgcagtccatgctattgtgaaaagaaggattgagcttaacgactgcaaggccccttccatgtgatcctctgaaatacaagaaaacttgagtggaaatagtcccaaagagtgaatcttaccaggactcaaacccaccctcatgatttatgccttttccatgttgaacactgcaaacttccagcctcagagaacccatcattttttttttaaatgaagaccttaattgtgcaaacctctatgaatgtgtgcttgaaggcgggctgactgattagatcccggaaagcacaataatcagatcatggggtgcacttttggacacagatttcaatgctcagtgctctgatctttcttcctcccacagggaaaggtggctattgtgctggctcctgcggacagtccattccagacacagcaggcagcatccctaaaacatggctccgcccctcagggcgtgtgaaaatgctcttcttaagcaaatgccattaaacttgctccagattctccaagaagcaagaacccttccgaaggctttggagtgttatttccagcagggtactaaaaactgcttcagaatatctttttttatgaactataatttaatgctctccccagcatttattaagggtaaatgagaaaagcagctgaatgagcaatgtttctgtttcatgcattaagtataatatttctactgtttcctcaaagttcaaaatgcaacatctatgtgataaaataactctagacttctggggtagaaaactatttctttccttcatgacatacatattttccattataaaataaggataacttcataacctatgttttttttttctcttttcaccatggctgccaggaagctctcagacaaatgcaatgtttagcccttaacagaatttcctgaaacaaaaaatctctcttctttctcttaaaatttcctatcttccagctccatccatgtccctgcaaaggatatgatgtcattcctttttatggattcatagtattccatggtgtatatgtaccacattttctttatccagtctatcattgatgggcatttgggttgattccatgtcattgctactgtgaacagtgctcagcaaactaacgccggaacagaaaaccgaacaccacatgttctcacttataagtggcagctgaacaatgagaccacatggtcacagggaggggaacaacacacaccagagcccattggggggtggggtggggggagggagagcattagaaaaaatagctaatgcatgcagggcttaatacctaggtgatgggttgataggtgcagcaaaccactatggcgcatgttgacctatgtaacaaacctgcacatcctgcacatgtatcctggaactttaaaatttaaaaaaaaaattctgatcttttcttaaagcttcaatttaaccttcctattgtatatatgttcataaagtgggtgatactgtttcagagtgacccccagcctatgaatgagcaaggaggcagtccaagggcccagccatttctgtccagtgggggacctcctgcaatgcatgagtttctcctgagtttctccagagctctcccctggacttgccaagactttgccaggggcactgtggcctgatagctcctcctgcccagttcttctcccatccttgtcactttccatgtgttattctccattgaaacttctgctctcctaactcgttctcagacctgcttccaggagaacccaaacctgcaccaaggagttacctgccggcgcctcccacacccttcagcccctgcctcttcagtgccctgcaggaccctggcccaagcgcaccagccttctatttccctaactgccaggtaagtccgccccccacccctccatgactccctcactattttcaatcactcctaacaacggcctgttgggatttgggcttggagtcctccctattccacatgcaccctttctggctgagggctcacagatattcttttgaaaatagcaaacatagaagactgagctggagtcctgagggggcaccaaggagggggcatttcaggctgccagagaaggcaggggcactctgggcaggaggcagaaggatggaaagttgtctcctattcctggcactagggaaaagcaagagacattctgtaaggtacatggatgtgctttggtcaaggaataggccgaggcaaacatccaggccagaatgactcagtgagtttaggtgcacaggtgcatactccacttgttatataacctgtttgtgtaagttcatacttggcttggagccactattgtttgggaaggtataactgccctgctgacactgtacgggggctcttgggcatggctccacatgactcttgtgcagctgctggcacccagagaaagagaggagagggataaccagagccgtccattttgcagatggacagaggggagccagggcagggttcggcacagcacggcatggcacggctcacgcttgtgcccagagagagaaagagttaagctgctgaccctgaaggcaagggagagctggccgtgcagctgagcgtgggagcagctggctcaagcagctgagacagaacggacagtgtatgagagctgctgatgagagagctgctgagtaaaaccatattcacctgcttacggccccccgtctgttttttcagctacctgtccatccatccaccctccttgggcctcagttggggctggaacctgacacattcatctgcatatctggctctttcctcaatctggaatgttcttttgacctttctgcacctggctacttgcctcgttctttcagccttatctcagacacctccaggaagccttctctgatgctttcctggctggacgacaagggaggagcaagccgaggagggccttgagtgtttgcacggagatgaagttcctgcccacaggtcacagggggtggcaagacctatagttctgagacccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacacccccaggagcagccctcggttaagacaaagctgatgttaacagaggtatacctagcttcctcacagacacctgagtgagtcctacgctgtcccccagaggtgactgggtgggtggggtcccagttgcccacagctgacacctgctcattattgaacctcaatgcctcctccacttccctgtgccatttcccagctggggaagtgatgcttcctcaattgtaccctctccttccctgtcccatttcccagctggagaagtggtgcttcctcaattgcatcctccatttccctgtcccatttcccagctgggcaagtggtgcttcctcgagtcacctctcaaataaacttcccatcttcaaaaccttgactcaggctttgggggcacctgacaacaatcacaaagtcacctaaactggatgcctgtggtcacataacccagacactgccttccgtgtctgatttgtctgatctagtgactaagccccttcagcgtctacagtccatgtgctcctctctgcctgagcccaggcctgccttagttcaggcctcagcctctccccactgggctcattatccccaggctaatccccaggaagatgattgggccactcttctgcacacaaatctgtgctgtcttgcccttgccagcaggatccagtccaaattctcatctgccatgcagagcctcctcccacggtccctgtggcatctggaggctccccccatctctcttggctgctgccctggaaaaggcactcgtcctccattccacatacccccatggccttgcctctgtgccctgctcgtgctgttccttgtgtccagaacaccctgccactttgttgcctgcctaggacatccttttccgaggatcccctcagcagttacatcttttggagaccttccctgcccccatgatggctaatcactgttaccctctcatccgggtcgctcttgcacctgtgtctgtctctcttgtgcactttcactcttgtctggggcgttctgtctgcacacctgctgtgcccacccctgggagcgccccctgaccaggggccatttaagggatgctgtgttactgtggaaaggggtgggccttggagtcggagcaacctgggcttcacacccagccctgtctctgctaaaagaccccagactagttacctattctgcccgccccatgcttgttcttccatgaaacagaaataataaaacctacctatgaggttgttttggggaataaaatcaatgtgtgttaagtgttggcacataatttgtgttcaataaacaattattgttattttatttcctctctgttgagccttgcatagaatgtacatccaacccatgtgttttgaatgaaatagtaaaaatcaagactcaggtgacagggaaggagaaggagcatgttataaacacagaagcgggggagggctgagcaaacaggaacagaggaaaattatgctagatgtcaaccaaattgcatcagcaggggggccagtatctgttcggtgttctccctactgttccgggcatggtgtgattttccaatggcaggctccccatggtcctcagacaccttcagagcacagcagagtgacagacactgatgcatctgggggtggcccacatacgactgcaagcagatgagatggagcccgccagcctcccttggggtcctcagagagccacgctgttagcacaggtgccatcctggcctggagacccctccaggtgtctgtacacctgctgagcccacacctgggagtgccccctgagcaagagccacttaagggacgttgtggtacagtgggagagggcaggtcttggagctggagaaacctgggcttcacattgtctcagggccaatgggtgctcactaatgcaaacacacattgtctcaggaccagtgggtgttcaccaatgcaaacacacattgtcttgggccaattggtgctcaccaatgcaaacacacattgtttcggggccaatgggtgctcacaaacaaatcctggctgcaccattttctatctagtatgataccaggtgaagtatttaatgtttccatgcctgagtttccttgtctgtaaaataaacataatagcattggtggtgtaaccagtgttcgatgttggcacacacaaagtcctcagaacggtatctggctcttgatgagcaaggagcattatgaatatacatgctatcactgtggggtacttgctacattctccctctccctttcatctttagcctggcagagggtacaaaatgctataaccttctgttgtgggttgaattgtgtcttcataaacatatgctgaagtcctaacccctggtagctgtgaatgtgaacttacttggaaataagacctttgtcaatataattaatatgtaagttatgaggaagtcatactgtaggaggatggactctggatccaatatgactcttgtccttacaagaggagaagagacacagatagatacacacagggaaggcaagcttgtgttcacggaggagaggttggagtgatgcagctgcaagccagggagcaccaaggactgctggtccccgtcggaagccagaagagggagcatggccctgctggcaccttgaccttggacttctggcctccagaactgtgagggaatccatttctgttgttcgatttttttttttttttttttacagagttccgttcttgttgcccagactgcagttcagtgatgcagtctccactcactgcaacctccgcctcccagattcaagtgattcttctgcctcagcctcccaagtagctgagattacaggcatccgccaccacgcctgtatttagtagagatggggtttcaccatgttggtcaggctggtctcgaactcctgacctcaggtgatccacccgcgttggcctcccaaagtgctgggattacaggcgtgagccaccacgcccaaccccatttctattgttgtaagccactaactcatggcactttgttatggcagcagccacactttgtcacctcttttatcacctcctgctagagcaaagcgcagaacaacccggaggcctcttccctcttgtgatcgggggcctgggatgagacaggcaaagggacttcacgtggagcatagggcaatagcctcgtataagttccatgcccagagtggcactgagcttgttctcccttacacagggcaggcctcatgcttctaaaaataggagatttcatcaaagcatttatttttcaatgactaatggaatttaagaggaggaagtcattgggtttttaacttaggttcagtgtgtttttattaccgacagcagttggatccaaggtagggtatgtaacaaggggtgtaggaggagatattggagctcctatttatagctttataacgttttattatggaccgaacctggagccttcacatggcctatgtgactggggatcagggctccaccgtgtggagaagctgacagggtgccttcgatctgtcttttgaatgacatattgctgtttacttgtgcaatttaccagttagcagatttggaaatggtagtatttggtttcaattgaattaaccccaatgaatatacaggtggcttgtaaagaatccccaaaagctgagcatagtagtacatgcctgtatgtagttccaactaatctttttgggaggctgaggtgggaggacctcttgagcccaggagttcgaggccagcctcagcaacacagtgagacctcatctcaagaaaaaaaacaaaacaaaagaaaccacaaattaaaggtaaaactaacaactcccacacaaagaaagacaggacaatcaatagtggaacccgctatctccatttcaggtgcaagcctgctgctagcctcaatgaccattgacagtacgctgcctcacagagattttcaaattcaagatgtagtcaatctgttgcttcaggataaagatgacattttaacaggagtgagaaagtagcaaccttttataagaaactgttccataaaaagagatgtgtctgtcatgtggtttggtagacaaagttatatacacagatcaccaataaaaactcttggatctcagctgggagcagtggctttcgcctgtaatcccagcactttgggaggccaaggcaggcagatcacccgaggtcaggagtttgagaccagcctggccaacgtggtgaaaccccatctctactaaaaatacaaaaaaattagctgggcgtggtggcgggtgcctgttgtcccagctactcgggaggctgaggcaggagaatcgcttgaacccgggaggtggaggttgcagtgagccgaaagtgcatcactgcactcccgcctgggtgacagagcaagactccttctcaaaagcaaacaaacaaacaaacaaacaaaaaactctcggatctgcacattcaaaaagaaaaacttgcaagcagtttaaaaaactttctgtttaaacatattccgaatgaaaagtttcagtaggttttgctaaatgattattgttaaaatataaaaaggcaacaacttcttactactcagcaaggacagtggttgatactaaggaagatggaaattcactggcctgcattttcaactcccaaaacatttcattcctgatggacgggattacaggttgaagccgcttcatcaagttcagccagccttgtcacctgcttctgtttggagctacatcgtttaatgaggttcatttttgagctatccacgttgcaataacattggtcaccacttgctaagggttcccttgtgttttatgtgcccttattcatttaattctcgtataactatcccctgaagtagacacagtcagtattcccactttgcaggtgagaagatgaagcttgcacatgggcagtgacactggatgccctcgcagcagagcctgagacacatgctgggtgtgggaagtttaccggctggagagcaaggcagtccaaggtgcatcttggggagacttctatgggcaaagggcatcagttctgcggggcttctgagcagcacatggaatacctccagaactgtcccacaggggaagatggggcatttatctgccagctcctgcccccaggggtattaactccctgaatgtctacactgcgctgcagatggctgagcagcttcctggccatggagagggcctgagcatttggagaggcacgtgctgtgcttaaggtgggcaaacattggcccatacctgagcccacatggactgtctgctgcagcaaggctgaaattagagtgggcagagggagggtgtgagggggacactagaaggggctagtgctgtcattcagcaggggagcggaggagcgagaattacaacccacaccggggctccagaagtatcattttcccaatgtccagcaatgcttcctggaagctcagccagctggggctgctataacatcatactacagatgggtggtttagacaacagacttcacagtcctggaggccagaagttcgagaccagggtgtccgcagagtcagctccctggtgaaagcctcttcctggctgcagacactgccttctcacttctctggaggcaccaccctcatgacctcagccagccctcccaaagactcccctccaaagaccatcactctggggagctggggcttccagatacaaattaggggtggtgaggagcacaaacattcagaccatgacagcaacttagaatcagacccttcagagctttggaatgctgtcctccccgcaaatcctgcctgtctctctcccctcccctctccttcctcccttccacctttcctcctctctctctcagtctcatctgaaattgaaagacactcatcatgctctctggttttcacccaaccttcccttcaccatcactttcatcagagcaagacggatatctgtgttgcaagtttagcaaatgccaggtcttcccctaaagacgggtggaaggaaatgtagctcctcacaggcccagggtgaaaaagagggtaggagggagagccagaaagtcctctctgtgcttccaacatgtcacagaattggtgctaaacttgcaattgcctgtagtgcagtgttgggggtgtgctgtgattggtacgtggccacacctgtgctggctcctgtcctcacagtcctgtcagctcggggcagcgcttgcactaggggaaggctcatggcagatgcttcatggaagaggttggttttcctctgggtctagaatgcagaggtgctcacagcatgctggatgaaggtaatgaacctactcatatttgcagatgtctagtctgcagaaaagagtttcccaagaggagatgcctggattggatttgctttccttggctctgaggtcagaacaagggctccaggcaagagctctgatgtgtgggaccacaaggaagaactgcctgatggatgtgtccaaggatgaacgtgttttttgcacagtgagttccccatccctgaaggtgtgcaagaggagccaggtgaccacctgtcaatcatattgtggaagggacccaggcactggagaggaagatgaacaacagggtctctaaagcaagcccagaaccccagatgtgtgcaggctgtgtagatgattggaaggagatggggcaatgtcacccatggggtgggaggggacagagctgatacctccagtttaaactggctgcccttggagagagaggaaatggcctgggaaattgctatctatcagcccatttaaaaattacatgagtttatggaaggtaactctctcagaggagttcattctcttcactctccaagtcatttaaaaatagttcatccaagccctaccccctgaatgcatgttccccacattctcccttcaatttgaaagtaagagggcttcctgtggctcatacctcatgcatattcctagccatgttctaatcactaactccaaagaacttgaaagaggaatgagaaattgcatttcccaactgggaaaaaaacctctgtgtagcatggcaaactcctgggctgggagagggagctgttacataatcagatcttgccccagttacagattcaactttattcaagaggagtcaagagacactgagcaggggagaagaggctaaggtttattgtgtacctactgtatgccaggctttgtgcgaggtgtcttacagaaacagcccttcaaggcgagtgtgtttcagtccacagcttcagggaggtgaggaaatgtgccagtgttcgcccaggtaatagtgaggagttcatgctctgacctagatctgtctgatctttctttccacacacctcacaagaaatctcagggctgagaggctaaggagccaaattcagctcattgccattatccggcagcttgtgagagcttgctgtgcatctgggatggcgtgcaaagatccactgtgttaagggaagaacaaggaacgggttctgctcccaggaggtctctagtgagagacagacacgactcactaccacttgagttggtggggcttgatgccacatggagagtgactgcagggagacctgaaatgagaatgactctctctctctctctctctctctctctctctctctctctctctctctctatatatatatatatatatatatatatatatatatatgccttgcctgacttggaaaatctctctcatgaggaaacctctccagaacagaggtagaaactatcaagacagaaacatcacagaaggcccaaagcaatgatctaaaatatttcccttgtaaaaatggcactctctctctctttctccatgcctgcttctcctctgggtgaaactgcttcatgttcccacagcaagtaagtctccatccaattgctataaacacctccaagaatgtactacagagctttaagcagcagcgtgctacagactgtactcagcctttggtatactttggttttcttcattcatgcaacaattatttagtaagtaaatgcctactgtatgccaggcactgctctaggtgctggggtttcagcaataagtaaaataggaaaagtgtccctcctcgcatggagcttttcattctcatggaggggagtgatactaagcaaattcatttataaacatatcatttcaggtcataatgagtgctaaaaagaaaaataaatcaaggtaagtggcagtgagaagaggggacactgagctatggcagctgggggagatgtttttgagaagatgctatttcactagagacctaaaggaagtgagggaggtgtgggtcatgcagacatctggggaaagagccttccaggcgaaggagccagtgcacaggtgctgagatgaaatgtgctgacagcatcccactacttatgaacttgttgcatttgccctattgggactcagccccacaaccacccttttagaactcttctgtgtcatgggggctagcagcctacaaactgcctgtccttactccctataaatgatatctccttactcccatgctagcagagtcctgttagattccagcagtgagaggcactgatgcatcgttagaggaagaaaggacctcttctgctagtcaaagttccagcaccatcagctgtggctcctggttagcctcagaggctgtggttcccacgtcatctgtgccaagaacatcagccacgttaacgagagcagctccagcatctgccctgctgccacagtcatgcttccagcagtgtcagtaagagatgggatcagttcttgaacccaaactcacctggcatcaaaactggctctgtaagaccacagaatctgggatatgcatggtgtggcccaaaaaggaggacaaagtttgacacaaatggaatgtgactggaggagagtagctgaactcagcctcggcaaagaggagcttcttttaggcttcagaaattagaagtgagccaatgccaatgcaactctttcattttgcagagaggtgagcactttgaggccactgggcaggccagtggctgagctgggactgagccctttctcctggaaaggggagggagggtgaacgcacgggctccagggtgactctgcccaactccttttgctctcccagccctactggcacctctgtaaccatttcctggcatccagtgcctctctgaaatattatttccactttcctgggtggaacattgaccaatgcactagctctgtgaccttgacatttcctcgctgagtcttagtcttctcatctataaagcaaaaggtagaaaatgtgtagactttaggggggtgaggactaaggtaatggttgccatgtacctagctctattcacttcctcttgctgctacagcaaattacaatggagatttatcatcttccagttctggaggtcagaatctgaagcaggtgtcactggattaaaattgagtgttgcagggctgtgttccttctggaggctctagggagaatccgcctgcttgtcttttccagctcctatggtccacctgcactccttggctcctggtcccattcctccatcttcaatgccagcaaccttgggccaactccttctcagattgccacttctctggttctctctctctttgcctcctttttccacttataagaacccttgtgattgcattgggcttaccctggtagtccaggactactcattccaaagtcagctgatgagcagccttaattccatctgtgaccttaattccatctgtggccctaattccttcatcatgtaacctaacatattcacaggttctgggaagaaggaagtggacatctttcagggtggggtggaggtcattattctgcctcccacactagcatataagaggaactcaaacaaaggaagccatgagatctcccaatcaaatcccctctttgtacaaagcaaaattcacagctttgtctgcccactgtaccactccacctgggtaagcacaaaaatgatgccaagtagatgaagacactatgtgtctatcgggaccactggagcagatgcttccctgggtagctggacactttcttgaccacagatggcttttcattttttctcaaactactttgccctgcttcttgtgtcccaaaacagctatgtccctaagacactgtctgatggcagaacaagaatcctcactgttcttggaggaagtttccatcctgacagaggtctgggattgttgctggaaaggccctttggtaccatccagcactatcctagccatgagcagatgaggaaacagtcatctggagagatgcatgatggccagttagtagcagagctggatttaccatggggaattttttaatttttattttactttaagttccaggatacatgtgcagaatgtacaggtttgttacataaataaacatctgccatggcggtttgctgtacctatcaacctgtcgtctaggttttaagtcctgcatgcattagctatttgtcctaatgctctccctcccctcagcccctgcccacaggccctggtgtgtgttgttcccctccctgtgtccatatgttctcattgttcagctcccacttatgagtgagagcatgcggtgtttggttttctgttcctgtgttagtttgctgaggacaatagctttcagcttcatccatgtccctgcaaagaatatgatctaattcctttttatggctacatagtattccatggtatatatgcaccatattttcttcatccagtctatcattgatgggcatttggattggttccatgtctttgctattgtaaacagtgctgcaataaacatatatatgcatgtgtctttacagtacaatgatttatattcctttgggtatatgcccagtaatgggattgctgggtcaaatcttatttctggttctagatccttgaggaatcaccacactgccttcctcaatggttgaactaatttacattcccaccaacagtgtaaaagtgttcctatttcttactggggggttttgagcccacttagtgctcattctgtgctgtctcactgtccctcggagggggagcaatgacacttacaaccacctgctgtgggagcctatgggtggtggcagagcccgaacacctgcttccaggagccttgggcctgacactagtccctgcccctatgtgccctggttctgacctcagaacctggagctgagctggttcttagagagcatcttgttctacttctgatggtgcaggtagagaaacacagcccagagaggtgttgtgaccaaaccagaactcctgacccctgcccagtgtcaacactcagatcccacagtctctctgcacctgctatgtggaagaactcaacaagattgctgtccaagaagtcattggtgaggaagcccaggagatgctgcatgttgttttaggacgtgtgcccctgaacatatgctcccagcaccgtctcgcctgcagatgcacccagtcaaacctgatgggtcccaggacctcacgctgggggcttaacagtttccattccactctttcctgcaggaagctctgtggctcataaaacattaaaatgagcactgctgccatttcatgaaatgcccagcctgtgaagaatgggttaagggatttttgggagctgttgtgtctgaacacaccaggcacatctgggaggcacatctatgaatctccttcctcattagcatggcagctcttcaccctagggccccagatggggcagttgtcttacgctgcctcctgcgagaaattggagcccttctgccaaaataccattgctatgggtggaatgtttgtgccccccagaagtaaaaagttgaaaatgaatccccaaactgatggtatcaggaggtggggcctttggggaggtgatcaggtcgggggtgcagaatccttacgaacaggattcatgcctttataaaagagaattacaaagcactctgatatccatgatctgatatgatcatttctctgggccctagagataagcattcacaggcaagaaaactgagcctttgagataacgggcagctttcctgagtcacacagctgtggtatggggaagacggggctggaccccagctctgctaactctcagctaaccctgggccacatgctgtgacacacagtaggccttccagagagccagggagcatgatgatactagcagcaacattaccaggtacaaagaggggaagaaaagtgtgtcaacttcacggctgacaccagaatgtttctcaagcactgtcatggctaagaaaaatatttagatgaatgtctggagcagcaggtgtctgctgaatgtctgcatgtgtgctggttccagctacagaaggggcgggaaggcgctcgacatgctagagggaggagaaatcggggctccaggggcatctaagaaagcagaggggatgatgagcagagatgacagggagaggaaagaggaggctgtgagtggcaggatggagtgactcccccaccaccctgaaatctttgatatggtctctaaactctctggtgatttgttgtacatgggtgctgttgtttttgagaaaaccaaagaaggtactgaatttcaagttgggactatcatgtcatcccaagagcaacagaactggtccccaagaagcagaggagactcaaagcacagggatgctctgaatggtaaagaaatgttgaacttccttccctgtgctgtggaattgaaggtacgttgagaacttcctcccagctctcaggggcacagagacctccagcaatctcaaaggttgcacgggaatggcacccatcacaggcacaacatagaaaacatcctctgcttcagcaaaaccctaagcaattctctaaatctaaagtgaggctggtccttacagcaagagttgcttgttctttaaaacgaagaagtgtgtgggcaatttctaggaacgacttcgtgctctgagggctggaggctttggtagggtggtttccgagctgtgttttcccgcccctttttggcccttgggttttctgtaggagacatttatctctgtgggcctctgtttcttcactcagcaccctgtcccaacaagttctctctagccagggaaaagggagtcctggggcttagctagtccatgggccaaaatgagaagactctcagaggccacctatcttggctcacatcttagaaatgaaacagagtaacagtgagggaggagggcgctggtcttccgggagcaggtgactgccagcagagaccgagagaagacctctgaggcagtgcgtccccacctccctctgcccagctccctctgcccggtttaggagatggggacatctttatcattgacaagggcaagcatggaacgttacacagcccctcttctctcctcagccatctccagatgggtataggtgagctgagggcctccaggtaaggccaccacagacagcagggcctgaagagccagctgatcaccccgtggcctccttcctgggttctgcgttggttgttggtgggtgtgtttggtgcacaggtgagggagtaagcgaggagtttacctctgttgcccctccctcagcaagagcctacaaagcacaaagcccagctccctcaagcatcagcggcctccgtttgtgcctgcatttacctgggcctgcccgtatctatgatgtccacacttctgtgatcacacagattctttttatgttctctttgttcccccccgaacattatgtcctaagcatgccttcataatgctacaatcatctataattgtttgttaaataagtgaattaaattggcattgggatatcattttcagttttaagcagatacacgattacttatctaactgttcttagatgaaatggatgcaaatctggaatttaaccctggcttaatatataaagtcataatatttcaggagaaattttctgtgtctccaacccatggattaatgatcttttgctatttttttttttttttttttgagatggagtctcactctgttgcccaggctggagtgcagtggtgtgatcttggctcactgtaagctctgcctcccaggttcacgccattctcttgcctcagcctccagagtagctgggactacaggcgcctgccaacacgcccggctaattttttttatttttagtagaaacagggtttcaccgtgttagccaggatggtctcgatctcctgacctcatgatctgcccacctcggcctcccaaagtgctgggattacaggcgtgagccactgcgcctggccgatcttttgctattatggttgtctttatgtgcacgttatgtcttataaataagagtcacacacacgctcaaggcagcaccctgcacttcagtgaattcaggtttgaatgagacaaactgagttagaatctcgcttctgtgatgaactatctgtggtatcttaggcaagctactcagcctctgagtggtcatttccttgtctgcaaagttttggagatcacagaagcaaagcaccatgtgtattgcaggcactggaggctgggattctcctaaactgacaagggtggcataaataaataagacccagggcctgggactcattccctgccactatgaactgggggtggggatggagtggggataggaacatcccgaaaggggcctcttgtctgaagtgattgtgttgatggcccaagttcgtggcctccctacgtttatgtcctctaccctaaaactttgaagccccttccactctgactttgggttagctatgtgacttactttggccaataggattttaggagatttcaagcttagagaaaacgcttgtgttttccatttcctctctgattaccatgagaatgtgccctgctggccagctggggatgaggtgcattgaacagagctaaggccaacctaggtcagccaggtgaccaacagacatgcgagtgaacttcagctggccccaagaaagattttaaggtcaagccctactaagattaacagaacaacactgttgacctataggtttgtgaactggggcatgctattatctaaagccaatgtgttttgggtgttttgttatgcagcattattacagtaatagttgactaacacagggcctcttttccccaaattatcaacagactggagaaggggtatctcccacagtgccgagcatggtgctaagtaataaagtgcattttgtttacattcataagttccagagccagactgtcagaattcaaatttcggtgctgtcattggctagctttatgtccttggccaagttatcccatccttggtttttttttttaggtcttaaaatgggaataaaaatattacctactttctatggttgttgtgatgatttaatgagctaatgtatgtgaagtgcttagaatgaaatagttttcaatacagatgagccattagtgggtgtttctgtccatctcccttaactagaccttcaccctccctcactcctggggggcaggaatgtcatctcataccactgtctcaccctgtcacctggcagaacacccaacatgctaaatatccattgcttgctgaatgtctggagtaaaattagcacttttataggtacagatgaaaatttcaataagctatttcaacttaaggccaatatctttgttctttttatagagtgcacatgtaatatttatcacgttttgtaactgtacttctccctcactccctactgtgctatgaaataaaactttaaaaccttcttcactgtctggcattgacatgcactattcattccaactgtacttaattgaagcatttctcaagagagccagagggggtgcgggttaccctcccaggctagtagagacagagctggaggcctcaccctcttccaataatgcacagcccaggtgcatctagaatcagatccccttggttctctctcttagtcaccttctttttactccagagactctgccatctgacaaccatctgaaccaaacttttaggtggtttttctcctcactggccacatgggaagtcacccggtacaatagccactacttccgtttcctggtatctctctgtgcacgaggggtgttggaggaaaatcttctttgggttccaatcctttggttactaacgggtttaagattgggggtgggagttactaaccagggtcctctggagaaaagagggctcaagtcccaggtctatcaccaagccataggcagaattttgtgtatatggttactgtattgaagaaaacactatcatttccatcatattttcaaaagcctctataaatctctataaaccaaaacccacagctttgggaaacggaattcatccctgtaagcctcagtttcttcatctgcaaaatgaaggtaataacaattaccttctctgacttcactttagagaaatgttataaatgagaaaatgaatctgatccataaactgctagacaaatataggtaattgttaatatttcattatgccatttgttaactcagaaaatacttaggtagtgtgaatttcaaaagatgttgcacaaattgtatatataattctcaagtcttttcctggatttggacatagatgaaatttagaactaaaatgcacagagttctcagtaataatgatagcagataatactacgaaccttatatgcaccatctaattcagtcctcacaatggccccatgagggaagtttatgtcatttcctttttacagatgagggttctggggctcagaaaggtttaaaaaattgctcaaggtcagacatcagagctggatgtgaaggtagtgctggttaccttcacatgcctaactaaccatggtgctgtcaactgcatctcattttataaaactaaaagaatcagaatgtgattgttcattctgcattgtctatctctaggcaacataattttgccttttcagggctctgtagagagatgtctctgattccgaaagccaagatttgaatctgactcagcatccccccatttagggcatttaaagaaagctacatgagacaactcccaagcccctttgcgagccttatttttctcccctgtaaaatgagtgtatactccttcctccctcgaaggactgttggcaaggtcctgtgggtcattgtgaagaagcactcagaccagtgcctggtgggatctggtgttcactctgtgcttgcatcttttcctctcctggcaggtaaatattaagacagaggaagtcagtgaagggagaagaagtggaaggagggccgccatgcacctaagccactcagaaatttcagatggcttcatctctgtggctgggaacaactagagaggtggtagtgagacactgcacagaagtgagggaacctgcgtcttatcttgtctgttctggcttttccagattccctgggagactccctgggtgactctgtgtcccctctctgtcccccagcaaggctgttgggaagatgaaatgagaaggtaccctatgatacccagcccagtgcctgcaaaaaggaacaatgacaacaccccttcctgtgcccattggcccaggtcccagcatgccttgcagtgatgatctatgcaggggctggagctgtgcaggaaagggaagggccctcacctttcacagctcttgcctcgttgtgcttctccaagagcaggtagcgtgggctgtccgggagaaagggaaggctcagcagctggacaacggcagggaccacaatcactccaaacaggtatggccaggtactctcctgtgggagaaggagatgctgctgagtgcagtggcctttggtcattgttgaggggactgggccactggaccaggtggtttcgaccctgcagaaggtcttcctgcccagcatgatccccaggaacaaaggctgagggaaggaactgagccaggctgggcaccagtcccacgtatatagcattttccatgcatgagtccagagactcctcaagagtcccctgtgagatagtgacctgcaaggtagctctgaaaagcaggcggctctggttggccaaggccactcaagggctgcttgaccccactccctggggaaccatggtgagcctgggggatcttagggtctccttctcttcaacaccagggctgcctcccaggctgccccaagaatggagcctgcatgtggaggtgacatgggcaccaccgctagatatctagacgcccacgacattcaaccatctctgtcttctcagtgaggacacaagaagggcagctggagctcttgcagaccccatgggagtgaggaagagggggccagtggggcacagcttaccccttagggagaggaggcctttcactttccagccagctatgaaaggcaaacagatccctacgacacgcactattcaagaggcaagtgatgcactccaagcagtgacatcccctgcagtgcagcttaaatgaagcccagagcacacgttacgatgcccatcaaggtagtattcgtcctaacctgctttcttcctacccaagtttacaaataggctctcagtgtgccactgaaagaagagaatcctgctcacaatgcagttctgatcatgagaaggaggaaaaaccaagtcctcaatgccacatccttgacacgtttatttcccaagaaggtacaaggagatggccaagggcaaaataagacacactcagacctgaaaagacttcacatgataggcagaggttctgttggcttcaggtggggcccatgggaagttaccctcaggatcctggggcaccagaactggcagggcctggggacagcctccccacctctcccccagctgcccgctgggaggcagggcttccctctgctgctctcccaagactcgctccctactgaggtccatggtaacagagacttttgcaagttctaggatcccatgaagggagagcagcagggccccagggctcagagtgagtggggaagtggcctgccaggggcacacagccagcagctggtccaatcatcatctccatctaaggggtgccttagatttgattcccttttctgtatctaataacaatttttattcacaaaactcctctggttccgccagccagcatagcccttccatcgccctttgaggaactggcaaggccaatgtcagctttccagtttcaggaggagctctcgctagaaggctgggaggggtaggctagggctgtcgggggcccaggagggccagggacaggggagtggggagtgactgcgcatgggtgtggggtttcatctagggtgatgcaaataccctggaattagggaaggccgatggtggcccgactccgtgaagataccaaaacccactgagctgtatactttaaaaggatgaattttatgatatgtgtgtcatagtttgatcaaaaagaaagaccaggaagaaaaaaccccaacatacatagaagtggaattttcgctaggcctgtgtgtggtggtgttgattttattttctctcggggtttggctgccgtctcagtaagggtaaaaacagaatctgagaaaacacgagggaaccaaccccatgaagctcctaccacgtgccggatgtgatgtgagcccttcccatggctgtctccttccaccgcacagccgccagccccacacacagccagcaatactgctgcatgttaaaggtgtggcaggcgattcctgtgctgaggcctcccagccaggagccacacaggtggaaatcaagcctaatattttcccacagtatcgtcacagtgggagcacttcccaggggtggtgtttttggagctgccactgggtggaagggcacccccagcataggaacagcatgtataaccacacagaggcatgatccacccaggctcattggggaacaacaactgtagtggaaacagaaggtcaggggatgccggagatgtgggagctgaggctggagccttgagcagaggtcaggtcatgggtggctttgctgcctttccatggctcttggacttggcttgaggacaacaggagcctttgaggggtctatgcactagctgagatggacactctctatttccttgaatctacaattcagtgtttttggaatcttagtcagtgggtatgtttcacattgcatgacttattcctgaaaggctgttatcaagtttatggcatagcctttgatccctggtctcttaaatacaaggacgtgtggactctttcttaaggggggtcgcatgggtgaccatggtcttctttctacctctggagaaaaggtggattctttaaacctcagggtgggcagcccccggattgggatgccaacatttctgaactggggaaggacaatggcagtggccactctgcacacatccctggggtgaacagcggaaaaggtgagggtcgggagtgtccagagtggagctcagataagagtttactccagagggactgagcttagccagcagaagagtctgaacctggctttttccagcaagtgttcagagatttcctggagatattagctggctgcagggagaggtgttatagttaggagagattattcccctcaccttctaccaagaaaagtgtgactgggtgtgtgggtagggtgtgtgttgaatgaagtgtttccacccatattatacatgtggcccacccaaataataaaaatagctaggatgacctgcgcacacgtcatctcaatgagtaagtgcctagcctgctcactcattcctgccgtggggccacaataaaggctctgctatgccctgtgctttatggaagaatttctgacaatgaacatgcacgtcttctctcccaatgacagtggtaaagatgtaatcgccatcagcaacccttactgagcaggggcttgcagccaggatcagggcaacctagtgagtggctatgggcacagctctcttgcaggctgtctggatttgaattctgcctctacccccactcactgtgctgtgggcaagttatcgaaatgcctatgcctcagtgttctcatctgtaaaatggggacagtgacaacacgtattcctagggaggatttctgttgggaggatttagtccatgaatggatgtcgggagtgctgagcacaggcctgcacacactgtaggtgttcaacaggaaagagtggcttttattactaagcacattggatagttcatctcttctcatcctcacaatagctcgcagacagagagcctgtgattatctccactatacagaaatattaactgcagcacagaggggttcaatagctcattgaggccacaactcggtcatagaggcatgactggccgccaaatctgggatcccagagtctgaattcaaatccaggaggcctgataagacatacctagtgaccagggaggagccatcagaccaccagactcaggggaagggccaggagagcttggtctgaacttctaccatctgacccaggcctaagaccctcagtggcccttgatggagctcctgggcacttggtcccaacacagagctgaggcctcagtgttttacattagatgggcatggcctgaaggcagagacctgctagcacacagtagtggttcaatacatgtctattgaaggagcaaatcagcgtgggaaagggctttcctacacactggtccctttcacaaacagcgcttgccattttcagacagtggcctctgagtgtctttttcaggtgctgttcaaaaaggaaggcatgttttaaaaaaccgcatattactcgcctgacacaagaccatgaggcgccaccaaacgacaacctcaaagatgagtctttgtggtgtcggtccagcctgctgggtttggtaaagccctagagcgtccatctaggagaacacaggcagagtctttgcacctgctatttcactcaggaggaaagaaaaggatagtcttgtcagccaaggtgatttttaactcccagtcaggtcaggcgaatgggctttgcaattatcttgttctattatcttgttctttaatctgcaggtttccatgttttaaatagacttccaggtcatatttcccccaagctatagactactttagtccataaataatatcatcctggactatgatgaatcagcaaaaaatgtttaagtagagttgaaatcattactcttaccccaagtcaagttcttataaaggatgttccaatatgctcatggcccccagacaagggagcacggtgagggggttgatgctggctgggccacttatgcctctgacagcaaaagggctccagaagtggccattgctccatgctgctggattggaaaggggaagagcaagccctaccttacacagctatttgggggattaaatgaaatgctcttctttatatttcttcatatttaggctcttattctaataatggcttacattgatcaagtgggctccacgtgcccagctccctgctaagtgtgttacaaatgtaaccttgtgttacataagaacagtccagaatgtcatctaaatacaaccttgatctttgtctccttattcctctaaaatttaatccctggggctttatttccctgccccattctaggggctcatgtcttttctgctgaaactgagcagagtcctatcctagaatcacaatttcaatttagacatcagaattgccagtataaaataataatcaaaatcaactgaattgaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttccgagggttctggagtgtcccaaccttgggaccacccactcgtccttgcagttgtcctagcctgcaggtttgcaggtgctctttctctgtctctgctgcaaggtgtacatctctttctgtctctctccattgcagctcaagggatccagggtcaaggctgctctgcatatttgtgaaaggtgcaccgagcactcagctccctgataagggggtgggctgaggctaaatccagcccactctgaccccaacctaggtggccatgaggttagtgtattaatattaatcatgttttatgtgttctgtattttatttcgctttcatattgtatgacctttctgatttcagagagaccgacctttcccgagcagttattaatagcagctccctagctattaataattcctagagctagtaaacaacctgcctgagagcaggcctttcgtatgcaaacccaccaatccaaagtctatactccaatcacttcctttatcaaactctcacactctgagccaacatttcccctcccacaggccactccagagccaggtatcagacaactagggaacagccctgtagcccagagcctggcaacatgatctcaagcctgcctcccctgctcactcattcctgccatggggccacaataaaggctctggtgcaggctgtcccctccctctttctgcctcctgactgacccagtgcttccctgcgtggtcctgcatggcgtggtatgtcccctcctctagggaactgtgagtaataaattcttctttcagataaggttgcctccatgtccatcacctcgccatacaggattcatacaaattctgggtacattttagaacagctggttgcccctcccactcaggcatgtatgttcttgctgtaggtggccacttatttctttctaaacaccacccccccaccccttaccttccatgacacactctccctggttctcctccagcttctcgggatacttatccaaggttttgaggcaagccctcctctcattcatctcacacacatcccccgggtagtgattcttgaacttggctgcccattggaatcacttggagagtttttacaaactactgatactcattccttactctcagagatttggggttaattggtctgggggtgcggcttaggtgctggggttgttcaagctctccaggtgactctaatgtagagctatttgacggccactgtcctagggcttcccccacacctgcgtcacctgcagtgaatggtggtgcatggcccagaactgacaagcttgacttatagctgctgggagcattactggctgtggaccacagctgggcctgtcctctggaattgcccttgaaggatgtttcctccaccaaggctacccagccctccccaagaacaaactgcatccaatggctgactgatgtgggggcataaagttctgttcccccacctccaaattatcccactctgatgggccatcccagctccagagctccctgtgggctcaactgagacctctgttgtgctgagggttgctcaccttttccctctgctgaatcctggtcccatctcttcccctgcaggcactgatctgagctcattctccaatcagcttcctgcccacatctccatctcagggtctcttttctggggaactcaacctaagacacatctatgggcccatgattccaaatcttcatgtccatccacacatctgacaaaaattatttacttggccaaacattagtcagcccattgaaacttctcctaggcccatctgtgtacttccctgtaaaatacagctttagcaaaggacgctcctaggccattttagcaagaacccctttctgcagcacatctatctactcatcctttaccttatagcattccctcccgtggatgacttctctatctggtaccaatttccattaaagcacttgttattctgcatagcaatgtgctttttatgggtgtgtttccctatagacggagctcctgaagggccacccattgccttgttcctttatttatctgcccagtgccaggtaaaaggcaggtgtttagtaaatgcctgtttactgaatgcatgttggggaggatgaatgacagcacagataagagatgctccagctagatacagaaatccctgaaacgacagacactcctgctcttaaaatactttttataaaaatgctaaaactgtcctatatgttgtcctattagagggctgatgttttatagtattataaataatattttcccacaaagtattattataatttctagtccatagaagagaaaatgtagacctgtaaaggtcaggtaactcatgccaaggcacatgagaaattagggggtctggcagaacaagagcctggctcttctgatccctgtacggggctctttccttgacattattcctcagatctgcagttcctggagcaaagcactgctgccttgccaccttcccttccctcatggtggcagctgctagctgaatagggaatttatatgcagattctatcaggctgaacctgtcacactcctctatggcaggtcctatacagaactcatcagtgatcactcaagctcaactccaatagctcatgctattacaaaaacatcaagatagtgaagcctgcactcacattccatagggttgctttgttacatctttgaatgcttcctgcttgtttagcagtggggcctcacagggaaatagtgacagccagcaaatgttcatggagcttctttgaccttaccgtccctcccaacaactgcctcctgggaaggaccctgctggccacagctttactgaatcctggggtggggagcatgtggctggtcgtgtttgccttaccaaccttacctgttgggcatgagggtcaatgtcaccctctccacacctgaccccacagagtacaagccagctagtaagatggctcaattcattgcagcaaatatgttgttctagaattgctatttttggtgcgcattcatgctctgattctatttcaacactaacaataacaggtatctcaagaacatgggcttttgtgattacctctcatttttctctgttggaaataataatgagatgaacttccaaggctacaacactcaccacacaaaaagtggttttgagaattggatgtgagagaagcacccacatagagcccccccatgggtcatctttcaagaaatgctccttcccctattcctaaaacattttctatttttcaaagggtttggatgtcctctgccttgcttggttctcaagcaatcttatgggaaaaaatgctcaatatcactaatcatcagagaaatggaaatcaaaaccgcaatgagatatcatctcacccctgtcaaaatggctattattaaatgacagatgctggcaaggatgcagagaaaaaggaaaacttaaacactgttcatgggaacgtaaactagtatagctgtgaaagaaaacagtatggagagatcgagaccatcctggctaacacggtgaaaccctgtctctactaaaaatacaaaaaattagccgggcgtggtagcgggcgcctgtagtctcagctactcgggaggctgaggcaggagaatggcgtgaacccgggaggcggagcttgcagtgagccgagatcgcgccactgcacgccagcctgggcgacagagcgagactccgtctcaaaaaaaaaaaaaaaaaaaaaaaaaaagaaaacagtatggagatttctcaaaaaactaaaaatacaattaccattcaatccagcaatctcacctctgggtactactcaaaggaaaagaaattcatacgtcaaagggatacctgtactcacatgtttattgcagtactattcacaatagtaaagatatggaatcaacctaagtgtccatcaatggatgaataaagaaactttggtatatatacatcatggaatactatttagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaaggaataaatccaatgtttgatagcagggtaggataactaaagttaacaaaaatgtattttattcaggtgatggataccttaaatattctgactcaatcaccacacaaatatgtgtaacaaaatttcacacataccccataaatttgtacagataataaagaattataattgccatatcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcagaaaaggacaggaaatttacaaaagattcatttaatgtttggatgaatggttgcagaattagagtaggtatcaaagcagtggggttaagctgactgcctggaaggcagaggctaaagcactgtggcttccatgtgccacggctcagctcataagactcccaatgccacagaagccaagaaagagagtgccctctggagttggcccacctctgaggttgggtcctgaaccctggtcctgccacttactgattgtgagataacagataaaccacttcacccctctactcctcagtttgctcatccgtaaagtttagtccacagaggaggacctcacatgcagtaggggctttataagtgcttgacataattcgaatatatgtccctgccaaatatcatgttgaattataatcgccgatgttggaggtggggcttggtggaaggtgtttgggttatggggttggatccctcatggcttagtgctgtcctcatgatggtgaatgagttctcccaagatttggttgtttaaaatttgtggcaccttccctagccttacttctgcttttgccaggtgatgtgcctgctcctggagccctccccagaagctgagcaggtgccagtgccatgcatgtacagtctgcagaaccatgagccaattaaacctcttttctttataaattaccctgtctcagatctgtctgtcttttttttttttttaaagacaggatctcattcagtctcccaggctgtagtgcagtgacgcaatctcagctcactgcatccccaacctcctaggctcctcccaccttagcctcccggtagctaggactacaggcatgcaccaccaaggccagctaatttctgtattttttgtagagatgggatttcaccatgttgcccaggctggtctcaaacccctgggttcaagcgatctgcctgccacagcttcccagaatgctgggattaccggcgtgagtcaggtgtttacagccgtgcaagaatggccaaatacaatgtttgataaataatagaaataacaatgtcagagctgttttggaagagatttctgcattccagaagcggtcgggtcattttctgctatggtcaatttctattcacagattctgtgatctgaatgtcctataactctaacaagctgtaattcttgcattgtaagatgctttgcaaaagtcctagaatcatacacttgtgattttaatgttctatatccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcattgggcagtgacgagaggtcccacactgtatcatctgcctgtctcaaatctcagccacatgctgttgcttaaagagctggagccactgagggccaggtgggcccagatgtgggcactggtgccttgcccatctgagtttgagtcctctcctcactgcactgcctgctcccttggtcattttggacctcaaatttaaatttaacctctatgagcctcactttccttatcaataaaatagagataataaaacctgcattactggttgtgctggggattcaacagattacatgcaaagtgctcagcctaatgcccagtttaggagttttttgtttgttggttgttttttgagacagggtctcactctgttacccaggctggagtacaggggtgcaatcatggctcactgcagccttgacttcccaggctcaggtggttctcccacctcagcttcctgagcagctaagatggcaggcatgcactaccgtgcccagctaaattttgtttgtttgtttgtttgtttgcttgtttgtttgagatggagttttgcttttgttgcccaggatggagtgcaacggcaacatcttggctcactacaacctccacctcctgggctcaagcaattctcctgcctcagcctcccgagtagctgggattacaggcatgagccaccatgcccggctgattttgtatttttggtagagacagggtttctccttgttggtcaggctggtctctgactcccgacctcaggtgatccacccacctcagcctcccaaagtgctgggattacaggcttgagccactgcgcccagccctaattttttgtagagatgaggttttgccatgttgcccaggccggtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattccccaccaggaatgtcaggtggccatcaggtgatggtcaggcagttgttaaactgtctctctaaaataatagttggtcacagctggcaattattgggaaaggcagtcagtctcccaatagaaaaaaacctaaaactggtgatcataagcttcccgacaagatctcaggagttgggcgagtgggctcaagcatatgcacgaagaggcaaaatggcagagtttacctggtatatggccttcctctgggaacttttgactggtgagggaaaaacgcctcaagtcagcatgtgcacaacgtcagtaaacacacggcgtgtgcggcccctcctaagtgctggcaggccactgtgcatgcaaacagcccaatccaaggggaagaatcagggagaggagacgcaaccccctggaagcataacatataaaactccaagtcggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactggggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaactccaagtcaaagttcaaaccgtgcacttgatctctcaagtcgctcccttggtgctctccaagtgtactttacttcctttcattcctgctgtaacgctttttaataagctttcactcctgctctaactcttgcctcagtctctccctctgccttatgcccctcgtcaaattttttcttctgaggaggcaagaattgaggttgctgcagacctgtatggatttgctgccgcggacacctctgtctctcaaagattccagatttgggtcagtattaaccttttgagccccactggacattctctagggattcttattcagaaagtctgaggtagggctcaagcatctggatttttttttttttttttttttttttttgagatggagtttcactcttgttgcccaggctggagtgtagtggtgcaaacttggctcactgcaacctctgcctcccatgttcaagcgattctcctgctccagcctcccgagtagctgggattacaggcacccaccaccatgcccggctaatttttcgtatttttagtacagatggggtttcaccatgttggccaagcttgtctcaaactcctgacctcaggtgatcgacctgcctcggcctcccaaaatgctggaattacaggcgtgatccacccagtgagcatctggatttttaaaaagtatcatcggccgggtgcagtggctcacgcctgtaatcccagcactttgggaggccaaggcaggtggatcacaaagtcaggagatcgagaccatcctggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggacaacagagcaagactccatctcaaaaaacaaaaaaacaaaaaaacaaaaaaaagtatcttcggccattctgatacacagccacctccacctatgagcctcttctctggaggaattgagagctttgttaccagcggcgttcacatagaggctgggtgctatttgagtctcagtctcccatttataatatgaatgtctcaggctttccttaaagggttttctagggctagcatttcaaattgtgatcgttctaaaatttattcatttgaagtttcctgggtgccttttgtgtattgggtaccgaaaaatttttttaaaacttcttgataaacaaggcagattgtccatgccgatttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcactcggagcctctgtgggggcactgaagggaagtgaagacatttgccccaaagacccctggtggctcagcatggaggacccagcaaagacagggtgagggtgggaatgaaaacagagttttggtggcaggcctttagcctcatgccctttattcacttcttgatgggaaccagaagatggggttcattctcacaatcaatggaaccacagtcattccaggcttggacataccagatacagcagcaaaacaggaggccaaaaacatgaaaataaatctcagagccctcagtaatcagcagtgaatcttttcccagaataggcatctcccattctttggaggagaatccaaacctccaaagagaaaaggcattcacacactgacttgtggggcctcccaatacaaatcctgctcacgctgtcatcactcttgagtgaagccttgtccctcacccacagcttttgctcaccttctttttaaatatgaatgggagaaccacacttttgaaaaagtgtctaacacaaaggagaaaggcaaaaagaaaccaacagaaagataaagcaatctggagcaaagagacaaaaatgtagcagcagaacaaatgcagggggcaatacaccctatcagtaataccctctaaaatatagttgtaaatattatatctaaaaaacaagaacaggactccatgtaaaatgaacggggacagggggaaagcccttagaaattaaaaatatgataaaataataaaaatacagtggacaagttggaagatggatttgagaaaatgttccataaagaacaaaatgataaagagatgaaggaaaggacagaaaatactaaaatcaaacttagaagagcagcctattatctgactgcaaggagtttcagagaaaggagcaagaatagaaaaatgggaggttaggagaaaattatcaaagaagtaacataatgatctagaatgaaaggaaatgagtattgagaattctgcacaactgaagagaaagattctcacctatggaagtaatcatacaatttcaaaactagggataaataagaagattctaaaagttaacacagaaacaacagttcacatataagtgatcaaaaataagaaaggcatcagatttctcatcagcaatgtcagatgctacaggacactgaagcaatgccttcaaaattctgaggaaaattatattcatacaagagttctatatctagcctaactatctactgggtataagtatagaataaagacatttttagacatggaaagtctcaaaagctttgtcttcattgcatgttttcttcttaagaaagtactgcaggaaatgatttagcaaaacaagaaaataaaccaagaaaaaaaggatgagttcatgtactttgcagggacatggatgaatctggaaactatcatcctcagcaaactaacaaaggaacagaaaaccaaacaccgcatgtcctcaactcataagtgggagttgaacaatgagaacacatggacacagggaggggaacatcacacaatggggcctgttggaggtgaggcctaagggagaaataacattaggagaaatacctaatgtagatcacgggttgataggtgcaacaaaccactatggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatcagcttggccaatctctttagtgagatttaggccaatctctactaaaaaaaaaaaaaaaaatacaaaaattagccaggcgtggtggcgggggcatgtaatcccagctactctgatggctaaggcaggagaatcacctgaacctgggaggcagaggttgcagtgagctgagattgtgccactgcactgcactctagcctcggagatacacgaaactctgtctcaaaaaaaaaaaaaaagaatactgaggcctcaatcatcagattgatgtctcaatcttagacatcaatggataatatctaaagaaaatgaatttaaaagttctatcatcaattattttaaaatatggtggaattatcaaataacaggtaaaagagttgtaagagattgcctctggagagcagacagggagcttgagggggtgggacgatggacctctgtgtgtcactataagccttttagcagtattgaattttttcaatcatttgcttgcattgttttgactaaaataatttaaaatttaagacaaagattagttgaaatatgaatacttttcctttggggttccctttgtggagtttcaagtgcccctttgagatttgtttttggtagtgaatccctggtctacactctcaggctccatttgctgtgactgagctgcacaaccagactgtatcctgggcctaagaaacgtggatgttctggctttcggggaggggctgagtcacattcagggtccgacttgactgctagatgaatttggtggtaggcagggagataatttatttccaagcattgtcccacttcaacaccacgcccttctgggcaggaaccagggctaactgggttatattctcccccagtgtttaaagcatggaaaggaatcattatcagtgggcattacttggaaaagccgcaagtcaagaagttatacaggagaggagccttattgttccaaatattagaatttgaaatctgccagaagcaacatctgtctcatccagttattgaagtgcagcatttgaatttacatctctccagggccttgagcctacccaagtcactcaggctccgctaaaactgcacagactggcactaaagatgcaaaataggcctttctgcctggaaaataagttccccttcaccagccccaggtatcaccctctatacaagtaagttaatacaaaatgctgcctaactctccccatcaaatacctaagttggtggacaatattaatgatgcctactctatgctgggcagtgccagggaagaaaggggaatatgaacaggagtggcccagccccttaagggtttacagtgaaggtgaagtcagagggaagcaagaagacacagctcctccccatgtacccctatctgatcaaaggcacccacagcatgtgaaaattcaacagaggaagagaaagcttttgtcaggagccaaagctcacgtggcattcagcatctcttctcatttccattttcagaagggctgtgaaaatgctatttcttttttgttgttgttgtttgaattaggcttttcttgaaggctgagtgacatggattgagaggggtgatgagagaggtgattccaggcccagggagtggcatgaggattatgggatgatagtcagcagaagggaaatgggggcagttgaatggcactagaggatagaatgggttaaaattggagactgaacccaaattcgggagccttcaaggctagactgagggattagggcttcatttggtggacacaggatctgttgtttgactggatggctcccatttgcagaaacggtacaaagtcctttacatatagtgtctcttttaatcattgcattaactccatggagtatgtattaatattattgtcctcattttacagaatcagaaactaagcctcagagaagtgaagtaacttgttcaagtcatacagctagaaagcagcagaggtagaattcaaacctttaacttcctaactcccaagtcagagcaatttccgtcatgctatgccccttcccacagagaggcttggagtgacccagccaaagcacagtgctagaaagatgtttgggcagcatatagccaagacaatcctaagcaaaaataacaaagctggaggctggcttcaaactatactacaaggctacagtaaccaaaacagcatggtactgatacaaaaacagacatatagaccaatgaacagaatagagaactcagaaataagactgaacacctacaaccatctgatcttcaacaaacctgacaaaagcaatggggaaaggattctgtatttaataaattgtgctgggagaactggttagccatagacagaaaatggaaactggaccccttccttacaccttatacaaaaattaactcaagatggattaaatgtaaaacccaaacctaaatgtaaaacccaaaactataaaaaccctagaagaaaatctagggaataccattcaggacataggcatgggcaaagatttcatgacaaaaacatcaaaagcaaaaattgacaaatggaatctaactaaactaaagagcttctgcgcagaaacaaaaccaaacaaaaaactatcatcagagaaaacagacagcctacagaatggaagaaaatttttacaatctatccatctgacagaggtctaatatccagagtctagaaggaacttaaacaaatttataaaaatcaaacaaacaaacaacatcattaaaaagtgggcaaaggacatgaacagacacttctcgaaagaagacattcatgtggtcaagaaacatatgaaaaaaagctcaacatcactgatcattagagaaatgcaaatcaaaaccacagtgagataccaatctcatgccagtcagaatggagattattaaaaagtcaagaaacaacagatgctgatggggctgtggagagatacgaatgcttttacactgttagtgggagtgtaaattagttgaaccattgtggaagacagtgtggcaattcctcaaagacctagaaccagaaataccatttgacccagcaatcccattactgggtatatacccaaatgaatataaatcattctattataaagatgcatgcatgtgtaagttcattacaacactattcacaatagcaaagacatggaattaaccgaaatgcctgtcagtgataaactggataaagaaaatgtggtacatatatactatggaatactatgcagccataaaaaagaacaaaatcatatcctttgcagggacatggatggagctggaagccattatcctcagcaaactaacacagaaacagaaaaccaaacactgcatgttctcacttataagtgggagctgaagaatgagaacacacggacacagtgaggggaacaacacacactggggcctatcgggggacctgggcagggggagggacagtaaacaacctaatgcatgctgggcttactacttatgcaatgggtcaataggtgcagcaaaccaccatgacacatgtttacccgtgtaacaaacctgcacaccctgcgcatataccccagaacttaaaataaaacttaaaaaaggaagatgtttgggcaggtgtgactgaaactgcagatgtgtgcagaggcagggagtggatgagtgtggccccagctgaccatccacctcatcacttgttgtcacctctggcactcttattaaatcactctcagtttctaaatgtgcagagctccctcttgttctttttttgtttttgcactggctattccctgtgcctggaatggtgttttccttcccttcatttggctaattgtcctccagaccccaaggtggatgccaccttctccagaaagctttccgtggccctctctcgctgcattagggccattaggaaagaggtctaacagacttccacagtttaacatggctgggaagatctcacaatcatggccaaaggcaaagaaggagcaaagtcacatgttgcaatggtggcaggcaagagagagcatgtacaggggagctcccatttctaaaaccatcagatctcatgaggcttattcactaccatgagaacagtataggggaaagcaccaccatgatccaattatctccaactggccctgcccttgacacgtggggattattacaatgcaaggtgagatttgggtagggataaagccaagccatttcaggaccattaaaaaattcactaatcagggtcttcttcataattccaaggtcaagggaaatgtgtaccttccctccacattgagggggtagctcaatgctacagaccccacggtcagctctacgttgatacaaagatgagaacttggactttggtcccagggaaaggtggacacgcggatgaccacctgaccactatgtagaacaaagcaagtctgtgagagaggagtactgtttgtgggaggcagagatggggacagctgattctagtggctggcaggagagagggcctctcaagaggcccctgctcgctgggttttgcaggatgacaacagtcagggaatgtagaaaaaggaggttgggaggaagaaacagcaaaggcagaggctgggaggtgggacccgcattgtgggatcctggaatgggatgtggagtcacagtgggatcctctaccttttgtgtgtgcaagaatcacatccagcgagtctgataaacaatgaagattcttggggaaccacctgcttcaagattcagatcttgaggtctggaatggggctgagaagtctcatttaacaaacacccaacacgcttgttaattccaatgtgctgtctattgggcttagctgctctgtgaggtggaggggtggatgggtggagataaagagcctggagccaggtcatacggacctggcacgtcaccatcctgggaggtctaaaccctgcagagggaaatcagggagtcaacactgaatatcgagggggagacattcgagaattcttacaaaagagttgctgaatgtttattaaagccaattttgtatgcacccgggtatacaaaagagtctgaaattatacatgtcgtgtaggtttcagaatcttggttcaacagggattggccagggcagggatgagaatttgcatttctaacaagtgccttcccagctggtgccagttctgctggtcctgggaacacgttttgagaactctggttgttatttaaaggagttcaggcattaacctgtgagggactctgaagtggcaggaagaatgcaaaggtgacaacctctaaacttcttttctcctatttcccttcaaaggaaattcatcatgcaatggccttcaacccatctgaacattttctctggctacagaaaatgcctgggtcgtgccccgaaatgaatcttcttttcaaagagaaacggtaggatttacaggtcagtggaggataaggacgatgttgctgggtggctggggcttaaaatcactttaaaatagatgagtacatttcttctaatattcttgataaaaatcaaaagttcttctcttcctggacttgaatgaagtccagagagttctaagtcaaaaagttcacagaaaacaagtgctttcaaacacttagggtctggatgagaaaaatatgaggctgcaaaggactgttttgctcaaattcctataccagactctaacctttggggacagccctcttgcctctccatcaacaagtcaggacgttggtcctaccacagagaaattatgggctgcaaaaccaggaagctcaagtcccactgcctccctgctgcagacattcggagtaattatcaccccgctctgagactgagcttttcatctgtaaaatagaaatttcataacatcttttctaagtactgccacatgacataaatgacgcgatgactgacatcaatttggcaccagttccaggcactgttccaagtgctgaacatgtattctctttcttaagccttacaaaatccccacgaaagaggtcccattattaatgctattgtataggtaacaaattaggcttggagaggttagcaacttgcccaaagtcccacagcaagtgtgtgtgtgagaggtgtggggagctgtgatgcagatccaggcagtcgggcacgagggcccaggtgcccactacacagccctgcagaggctgttttgggcctttccctttgaagctcatttctctctgatagaatcacacattatcacccttttttaatctcatgggaaatttttctgtattttacggattaaccataattattgtgatataataaaaatcacttgtaattttggatctgttttttaccattataaaatggtaagtgctaagaaagagctgccatccttaagcaaacatggaatattaacaaaagatgatcacaaactgaccacagaataaactatcatatgttccccaaagaagaaacttatggatgacctttctttatgtaataaaacaaaactggtaatgaatgaggataacaaaatcccatctacaaaatcccaaaatcccaattgaaaacattgttctaaataattaatctgtattcatttgtgtgttgtttatggtatctgtttttacatttgattcttaaaatcatttcagttattttttaaatggtgtaaatttatatagttgtatgctaacaaatttgaaagtttcgatgacataagtgactttattgaaaagacagaaattaatgacatcaactcaaaagaaaataaaaatagatttttacgaaagtagttaaaagatattcaaagcatttttttccccaaaagactacagggtgagatggttttactagtgaggtcttttaatactttgattatcaactaacgaaatgtgagaaattacatttctgtctctgctgtggttacttgttacagcatcaacaggaaacaaatatacttataagaaattctcatctattatttttgcctatcaaataccaaagcctcatttaaatgcttgtggatgacatgggcagagtgagactaatgcccttgtgccctgccagcgggaatggaaattgaagcagactatccgaaaaaaaattgctcatatgtacgaaagccttaaaaaaatttacactctttaacctgttatttctatttctgaaacactaaactacatgaataattacagatttgaataatgattaatgtagaagattattcatctgaagtttacaaatcacactttttcagtaataaacacactggaggctgggtgaagtggctcacatctgtaatcccagcactctgatgggccaaggtgggtggatcacctgaggtcaggagttcgagaccagcctggccaacatggtgaaactccatctctaccaaaaatacaaaaattagccaggtgtggtggtggatgcctgtagtcccagctactcgagcggctgaggcaggagaattgctagaacctgggaggcgggggttgagagccaaggtcgagccctgcactccagccttggcgatggagtaagactgtgtcgctaaataaacaaacaaacactggaaacaatccaaatgtccaggaaataaaagaaaaatgaaacaaattataactcataaatagaaactagtacaattattaaaacatggtgtaatgtaagcattgctttagtcttttttcctacccttttcccattttttcctaagctattcattaaaccaaacatttcctctgttgatttttgaggtttccttttgcacacattaaaatcatacatagaaatgaattttctgcttctggccatcccttagtgcctttgatctttccattcttgtgcccatgctgcattgttttaattgttgtcactttattacatgtttaatgtactcactagcgtccattttcaaaactatgtcagaaacatacacttgcttattctcttgtgggaactttagaactctttcctcattttccatcacaaacagaaatgtcattgaacttttgattgaaattgtattgaatgaatacattagtttgaatacaattgagattgttttttaaaattcattattatcattataaaattagtaaaactatcacagcaaataattttaatgacttgttcacaacatcaggttgcaaaataatcagaatacaaaaagttataaatggaatgaaccaaattatgtgcttcttaaattttataaaagactaaatatcattgggcctcttaatacacactaaaattatgttatgttgaaacatgtttataaaactaaaaaaggatttcatctataaaatatttgtatgtgatagtttaaaatttctttctagattttcactaaaaattaagattaataagagttgagcattctgatttctgcatataattctttatgtaaaatgtaccaaaaaagtaagaactgtttttaattaaaaaattataagacaaaatatgtacttcatttaaaaataatttttttaaattaaaaggttattaaaagttgtgtcaaaatatggatttagaaagaaaatataaacaaaaagaatccagtaaatagaaagagatataaagaaagttatgggaataaagatatatttctggtaagaaagatttaagaaaagaaaataactttacattaaaaaatcttgcctggtaaatgttttttcctaaaataaagtgactggttatttaaaaataagaaagtatagaacaaaacaaaagttataagcatgccatgaaagttacgaaagtctgtgtaagttgtaaaaggtctgaaaatgataaatttacaaaagaaattttgtatgtgatcaagttgactatatttaaaagggaattatttataagcctttctaaggtttgagttttgatattaaaaatacaccaatacaaaactaaaaatttggtcccttatgttaaagcaacaaagttttcttgaagtaatgatctgcttttagtaaaatttacaagaagttctgatttttaattgtaaaaattttcagccactttctaaactgtagcttatttttttgtttgttttatagtctccatttaatttaactagtttttagtttaaaatgctatcttcttcttaaaaatggtatcttcatttctcaaggtggagttttcgtcttgaagcttctcagagtcctatctcagaagttcaattttaatgtgtctcacagcatagcatgtgcagttcatactacattgccttctgttctttcactttctttccttgagaaggtacatctttttgcttggctggaatgttgactttctccttcaacttctttgttagctcctataacttcttcctctcattctaacagctattgaggcctgacactaaaaatgtttgtctcaaagacctagaaaagcaatgtttctttttttccagtataacttgattctgtacttagcttttcttcatgtgtctacattgttccatgtaaccagggaatttctcatgcttttactaagagccatatatccccctgcttaaagtaatacttttcttgtttatgttccacagtgtacagtcatagccttggatatacattctgaatacatacaagtactttttcatcaggttgtctaaacaggcttcccatgaggtgaaccaatcacatagaaggaggtttttcattgcctttttagtaactggcctaagaaacaaatattttatattttatcaagataatttcctgtgttgcctttactaaatttttttattacttttaaaaaatggagactttaagggttaaagtttttttaatatctatataactttctgtattgcttttaagatctataattatcactctaattaaataaatgactatcacacagtgccctgtgatactgttttgatcaggtattttaaaacttttggcatctttgatggacttccccagcatcaaaatgctaaattaaatctttttgacataaacttaactttgagattttccagtcaggcccctagaaagcctcaaaggacttctctctcatcttgtagagatattaaataattaggcttatttggtaaattatatgggaaatatcaaatgctaagtgatactagatcttctttcagttacatttatggatatgttattggtatatatgttctaaaatggtaataaaactcttaaaatcttctatgttatcagtcataattttggttattatattgtaggccacaaaataactaaatttccttgcaaatttctggttatggggaacttttatcctattttcaactatggtagttttaaatttttgtcatttacagttattttaaatttttctctaaagttatctgcaattagattcattacaaagactttgacaaatactcttaaatacaagtttcaaaaaactttaagatcaatgtggtttttttcccccaagatggcagattagaggcattgttagcatgcctcttgtattagtcccttttgatgctgctgataaagacatacctgagactgggtaatttataaagaaaaagaggtttaatagactcacagttccccatggctggggaggcttcacaatcatggcagaagatgaaggcatgtcttacatggcggcaggcaagagacagcatgtgcaggggaactctcctttgtaaaaccatcagatctcataagacttattcactatcatgagaacagtatgggaaaaatccacccccatgattcaattatttgccactgggttcttcccacaacacatgggaattatgggagctacaattcaagatgagatctgggtggagatgaagccaaaccatatcacctctcatacttggaaagacaaaatagtgtgtagagactcacgctataattttttttccaagaaacaccacaggcatttaaccagaaaactgaaagaaaccacagactctttgaaagaagtggtggcagcagcctacaccataagccaggtggaaaactgtgagtcctcagagtgtggcagtgggagagactgcctctgtgacacacactcccgctagggaacctgataatataggccatgggggatggccttggccccacccagcactggagctgagtggtggggaatgttgagaaggagcagcatcggacatgctttgcgtgcactcctagactccagtggggatggagagaagacattcctgactctacttcacagggagccttgcagaagtcagccagccaactcgggtggcagtcacaggttgagagaaggtctcaactgtgattcacgacataatcttgagtggggatgagctcccttggccagaactaaggggcaagtgggggtactgtagtcacaagtacagaagctgggcatccctgctttggggtggaccaggaggggcacagcctgaaaaccacagtttctgtctgggtggggaaagcttatagcctgtggcagttttgagttctcagtgcaaggttcctggaacccagctagctgggttaaacaaacaaaaagagtttgtgctgttgctaatactacatgctatacttggataaattcccctagaagagttaagactcaaagacacaaaattaaaaaaaaaaatgcaggttacaatgagggaagaaagagacctctcatattgttttatactcagtacctgttttaagaaaaaaacaaggaagtgaaaccaaaggcaggcagcccagcgccaggcgccagacccaaaaccggacccaaaaccaggcctgggcctgcctggcctaaacctagtagttaaaattccacccctgacctagcaactgatgttatctatagattccagacattatatagaaggacattgtgaaacctcccattctgttctgtttcactctgaccaccggtacatgcagcccccgtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcattgtgtgagaggttttgtctgtggctcatcctgctacaacaacaagtttcacctaatttgtcatgatcatttaattaatttaatttatttaatttatttaattggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaacttaaacttaacacttgattttaggtagatgtagcctgagaaccactctctccaaacccctcttgttgctcaaatgtagctaaaagagtttagacactaactccaattacaccttccaatgtaggaccaaccaacaacgtgagacaggttgatcccagctgcctcacctagggataatcaaaacctaactacaaaatggttaaccagtgatttttttaaaaaatcttgatcaaaaaaggaaatgtgaaagttgtcagaataaaaataaagtcacctgtgttaaaaagcaaaaataaaagcaaacccctgaaaaataaagctaaggaaggtcatgaaaggaagattctcatatacagatgcctgctggcaaaaactattgcaaaagactgcaaaaaccttgcacaaaggccactacaaccttacacgagaaaatactgctgcgagaacacctgcctagcaactgcctgtccaaccttggactgatgccacccttgttactgatccttctattcaaagataactatctcaaaaacaattacataattcgtctcattttttctttaaaatcctttgtcttctttcacctccctgaatatgcacatggtttactatggcacacctatgccaattgcaatgcccattcctgaataaacattgttttctttcagaaagtctccctgtttgttatttagattgaaaaaatttgcaaccattagtatatttctttccttgagaggaaagaaaagtgggagctcaaagttaatcattcttatctgacataaatgttcttctgagcatataaaatcgttcctttacggcctcacatcattcctaatctctcttctcatacttttgcctataattttcatctaagtctatttcttctttatctttgcaagagaaatagctaattgatttgttttaaaaaaaatatatcatttggagtcacataaatgttcagccatgacaattgttttatgatgtatctttgattaaattcatggaaccagcattaattcctacatttatttccctttcttgccttctagcagcctactctaaaagccaccttcgtctaccacaggctcagccataaagcaagtctcagtagattcaaaagaattaaactcataccaaccatactctcagaccacagtggactaaaattagaaatcaacaccaagaagatctctcaaaaccacacaattacatggaaattaaatgacctgctcctgaatgacttttgggtaaacaatgaaattaaggcagagatcacaaattatttgaaataagtgaaaacagagacataacataccaaaatctctgagatgcagcaaaagcagtggtaagaagaatgtttagagtgctaaatgcctacctcaaaaagttagaaagatctcatattaataatcttatcaccactcctagaggaagtagaaaaacaagatcaaaccaactccaaagttagcaaaagaaaagaaacagctataaaatcagaacagaacagaacaaaattgagatccaaaatccatacaaagaatcaatgaaaccaaaagttcattatttgaaaggataaatgagattaatagaccactagctagattaaaaaagaaagagagacgatccaaataagcacaatcagaaatgatgaaggtgacattataactgattccacagaaatataaaatatcttcagagactattatgaacacttctaggcacacaaactagaaaatctagaggaaatgaataagttcctggaaactcacaatttcccaagattcaattaggaagaaactgaaaccctgaacagaacaatatcaagatctgaaattgaaggagtaataaaaaacctaccaaccaataaaagccctgaaaagatggattcacagccaaattctattagatgtacaaagaagagctggtaccaatcctgctgaaactattccaaaaaattgaggagggactcctctctaatttgttctttgaaatcagcataacaccaataccaaaacctggcaaagatacaataaaaagaaaatgtggcacatatacaccatggaatactatgcagccatgaaaaatgaagagttcatgtcctttgtagggacatggatgaagctggaagccatcattctcagcaaactatcgcaaggacaaaaaaccaaacaccgcatgttctcactcataggtgggaattgaacaatgagaacacatggacacaggaaggggaacatcacacactggggcctgttgtggggtggggggaggggggagggatagcattaggaggtatacttaatgttaaatgacaagttaatgggtgcaacacaccaatatggcacatgtatacatatgtaactaacctgcacgttgtgcacatgtaccctaaaacttaaagtattaaaaaaaaaaaaaacagaaaactagaaaccaatatccctgatgaacatagatgaaaaaatcctttacaaattaccagcaaaccgaatccagtagtatatcaaaagtcaattcaccatgatcaagtaggcttccttcctgggatgcaaggttagtttaacatatgcaaatcaatataggtgattcaccacaatagatgcagaaaaatgttttgataaaatccaacaagccttaatgataaaacctctcaagaaactaagcattaaacaatcatacctcaaaataatgagagccaactatgacaaacccacagccaacatcatactgaacaggcaaaagctgaaagcattcctcttgagaactgaaacaagacaaggtgcccactctcaccactcctattcagcatagcaataaagttctagccagagcaatcaggcaagagaaagaaataaaaggtattcaaataggaaaagaagtcaaactatctctcttcactgatgatctagaaaagactccaccaaaagtctcctggaactgacaggggatttcaggaaagtttcaggatacaaaatcagtgtacaaaaatcagtagtatttctatacaccaataatgttcaagctgagagccaaagcaagaatgcaatcccatttataatagctgccaaaaaaaaaaactaggaaataattaaccaaggaggtgaaagatttaaataaagaaaactacaaaacattactgaaagaaatcacagatgacacaaatggaaaaacattctatgttcatggattagaacaatcaatatcattaaaatagcaatactgcccaaagcaatctacagattcaacactatttctatcaagctaccaatgtcattttccaccaaactagaaaaaaaaattctaaaattcatataaaaccaaaaaagagcccaaatagcccaagccatcctaagcaaaaagaacaaaagccagaggcatcatattacctgacctcaagccatactgtaaacctacagtaaccaaaacagtatggtactggtacaaaaacagacacatagacaaatgaaacagaatggagaacacagaagtaaagctgtacacctacagccatctgatctttgacaaagttgacagaaataagcaatggggaaaggacttcctattcaataaatggtgctgggatagttggtttgccatatgcagaagaatgtaactggacccctacattttaccatatacaaaaattaactcaagatggattaaagatttaaatgaaagacctcaaactataagaatcctacgagaaaacctaggaaatatcattctggacattggccttgggaaagaaaattgcaaaagaaattgtaacaaaaacaaaaattgacaagtggaatctaattaaactgaagagcttctgtagagctcttcaattcaagcaactatcaatggagtaaacagacaacctatggaatgggacaaaataattgtaaactatcatctgacaaagggctaaaatccataatctataaggaacttaaacaattgaacaagcaaaaaacaaataaccccattaaaaaatgggaaaaggacatgaacagacacttctcaaaagaagacatacaagtggccaacaaacatattaaaaaatgctcaacatcactaatcatcagagagacgccaatccaaaccacaatgagataccatctcacaccagtcagaagggctgtgattaaaaagtcagaaaacaacagatgctaatgaggctgcagagaaaagggaacacttatgcactgttggtgggaatgtaaattagttcagccactatggaaagcagtatggaaatttctcaaagaacttagaactaccatttgacccagcaatcccattattgggtatatatccaaagaaaataaattattctaccaaaaagagtgatgcactcatatgttcatggcaccactattcacaatagcaaagacatgaaattaacttaagtgtccatcaatggtggactggataaagaaaatgtgatacacatacaccgtagaatactatgcagccatgagaagaagcaaaatcatgttgttcgcagcaacatagatggagctggaggccattatcctaagtgaaataacacaggaacagaaaaccaaacactgcatgttctcacttataagtgggaattaaacaatgggttctcatggacataaagatggcaacactagacactggagacagtgggatagatggaggggagggatagaggggagaaaagttgaaaaactattgggtagtatgttcagtacttgtgtgatgggataaattataccccaaacttgagtatctctcaatatacccaggaaataagtacgcacacgtaccctcttaatttaaaataaaagttgaagtcataaaataaataaatagctaccttcttgctaaccctccttcaccctctgtgtttcaaagcaattgccttcattgaagcccagtttttctctctcttttttcaaagcttcgttgtctcagtctttgaaggtaaatgggaaatatgattaaaatagtgaaaatgaaattctgacacttagtgaaataactgtgaatttcacttggctggaacactgcaaatccccagagacatgaataaaaatttcccatttgatgttctttcctggaccagaagccctagatccacattcccagagcatacatttgaaaacagaaggatatttacagggttcctcacccatcttcctggccagggccaagactgtctggaaactcccatctgatgggaagagacagcctataggaaccaatggtacaccttttggctagctcaaagccagaaggtgggcatgggcagctgtgccccttggctggcatcatgttcatgagccctgttcctgggagagagtgtcccagcctcagaatctaggtacccaggtcctcgaatcagctcttccttccagttgctctgagacatgcacagttcacatcagtgaacttgtcaccttttcccctgcagagctactccttctctttcatagctccctgtcttagcatctggtaccaccattctatctggctgatgtgccagacgcctgagagttatttttgactcctcctctctgggacaccacatcccatcaccactaacctcactcaacctcatctgcctctctccatccacactgccattactctgacccaactcataactggaccagtcaaccccttcagtcctggctgggatccaatcctttctccatgctgcaggccaaaagccttcttgaagcactcatcatgtcctcaatgatgtcccattgctttggggtacaaataagccttcacagttacacagtccccatcaaggtgtgtgaaaggtggccctaaggctagacccagcccacaggtgggacgttttttgttttttaaaggtcagtttccaatatttacaaattatgaaatatgacaaatctggatttgtaatgtctcttgaaaatcagaaaatctgtcatctctaggccagtgtctgtgatggaaacagtaggagatgcccttgtccctcaagcagccacaggtcctgggaacctctcaccttgcccatccttccctgtgctcatttacagcataggtgtggccctctctgctgcctgccttgccagcggtctctccctctccctctccccctccccctccccctccccctgctcctgacacctgagtttttctgcctctgaacaaatgccagggccttcccccatactcttacctctggctagaactccccgcccccattgcctctctcttcctacagacccgcccagataaatcctactcatcctcaagccatgagtttagatgtcactgctgcaggaaaaccacccccgatgccctaccagaggtcagtgcctattttcctattacctgtggccattggtcaattgccctcctgtgacctccgaagggcagggctagcctgatgatctcaccactctaccaccagcagccaacccaatacctggcacaatacctagcacacaatagaagctttctacacatttgttgaatgactggataaacttgacgcctctgggttagtgtgcacgcaagtaagatgccatcgactggcgggacaagatgcggaagcaaacggaaatcagtgtgggagaggcacaggtgcacggtgtcctaggatatgctgaacagtcactatttgccagcgatgttttcccagaggaagtcaagcttgagtggggcttgggaatttgggacttgcaaccattcctgttactgaagaggacactgggtcagagaggtgagtcgaccttcccaaggtcacaaagtccttgcagtctgagtaagaaagacgtgggctgtacctgatgtgctcaaagctgtagctccagaatcaactcaatgttttaacaaatgtggtgaatgaataaataaagggtgaagacagaggttgaagacagaccttacggactcaagcaggagaaagaacttgatattgatttataaacaaagtggaatttggaaatgatccccaaagagaaaagtttagctctactgaggtaaatatttatttactttttttactcctaaaggacaatagcactcttcattgacttttaaatgtatttttgtttagggagctgaggctgttatcttgtttttattatcaacatgtggtggttattttgagaattttaaaatatctttagaaacaaaaagcaaaagagtctctttagtttggaacctcacttaggttgagagactgtttctaacacactcgcaattaattatagaaatcgtcatgcatatgacaaccacaaatgtaaaatgtgagttgtttctgtttttgcaaaagaagaaactaaagtcatagccgtaataacccagaatggtcataataaaagatcagaagcagatgcctctgaggtgacctcgattggctgaaatataaaaagtcacttataatatcacagaaaagtacacttaagaatggtcaaaatggtaaactttatgtggattttaccacaataaaaaatgttcaaaacatttaaaatttgctttaaaaatggaatacagtgattcctccacttataaaaccttccactgaatgagaaaggagctggccctagagtcagtgaggctcagtagctgggacagaaaggaccctgtgggcagaattagccccttctctccagagcgcccacattcccagaaacaccagtgtgatccatccttggatgtgtaagacacaacccatacgtggctttgaaagcacacagacccgggttctggtttcagcaccaatatgcccttgtttgtgagagctctgtcccttacctctctctgcttgcgtccaaggctgcatatctgagctactcacaaagtagctgttaggatttgagcagcataacaaatgagtcttttacataactgctctaggacgtgcgaatttgttatgtttgccccctgctgctagaattcagctccacagggagctgtttgtctgttgtgcactgttcgtgcctagaacagtctggcatgaagtgggcattcgaccatcattagtggtttaatctctgcctaccctcctgccctgcctgtgtgagtgggaaggcagcgcccctgcatccctgggaggcatcccctgggaggaatcctagcaagtccagtggcctctttatccccatgtctaccacctcagtcgcagctgcatccttcccttaccatgtgtaccaatagcagcagccctctgcctctctcctccccacccttcccactctagtctacacccaccgcctccaccccagagccaccttctaacactgatctggccatgtcaccctccagctccagtgccatccagggcttcctattcccccagggtgaagtctgtggtggctcagtgaacagacgcttcatctctcaccctccccatgcctgctttctcctcagccccacagccatctgagttctttcccagggctgtgccccatcttgagccttttctttactgatttcctttctctggtatatcctctgtcccaatccccatcatcacctgcctaactcctgcttacccttcaggagtccatttagaggccacctcttctaaaaagccttccttgagtttaccccaccccattcgacctgagtgaaatgtttcttttctccctgctaaggccacacagcaagtaaatcatcgaactgggattcaaattcaggcccacctgctcccaaaacagcaagccaaaaccggaagactctacttacttatctattcaggaaaaaagagactaaagaatgaggtagagctaagctaacgtcttgaaaagatgcccaaaatatattaaatgaaaacaccaggttgtagaacaatgtgtatggcataattccatcaaagccacaataaactatatatgtttatataggtttttaaagcacagaagatgcctaaacaaacacaaattgagctattaatgataattactgggtgggtggacttaaacattctataaggtttcaatttgttatgtattctttatgtacttaaaaaaaataaactcaaaggaactccacaacttttctccaataataagtaagaggcttgaataccagaaattgcaaaatacagggaccagcttttggagaaaaggctccttcctgcagtggtaacatgagatgagagcagatgcggttgaccagggagccacactcacctttcccagcagctcgggcaggcccagaagctgcccagtgaacacgccaatgcagataaagatggcagtcacctgccccagagagccacggatctccttgggtgagatctcactaaggtacatggggagcacactgagggcgacgcctgtagagagaaagcatagcagcagttagagaggtgtcttcccgggggagctgcactctggttacaatgcctctcttggctctgctttgccctggacattaaatagcactgtagccacggcatttttcccagcacttagcacaaattgccaaagctttcccatgaactttataatttaatcctaaagtatgactggaggtgcatttcagaggacaggacacagctgatggtgttggtggaggtgatggtattgatggtgataatgacggtgatggtgataacggtggtcgtgatggtagtgatggtggtggtgatagtgatggtcatgatggtgatgatgatggtagtagtgatggtagtaatggtgatggtggtagtggtagtgatggtaatgatggcgatggtgacggtgatgatggtggtggtaatggtagtgatggtggtggtggtagtgatggtcatgatggtgatgatgatgatggtggtggtgatgactgtgatgatggttgtggcaatgatgatgatggtgatagtggtggtggtagtagtaatggttatgatagtgatggtggcgatggtggtgatagtgatggtgtggtggtggtggtgatggtgatggtggtgatggtggtcacaatgataatagccaatacacatagtggctaccaagtaacaggaatccttctcatctctttatatgtattaacgttatttacttttaacaatagtcttctgaattaaatatactattaccatttctcttctaaagattagtaaactgaggcacagaaaagttgagtaacttgcctaaatcaccaagtaatgtccagagatgtttaaaaaaattattttgcccaatagagccccagtgggtctctgatcttagaacttgcacttttcccaccagctaacattgcctcttgtcataaattatgggactccgttatggcagatgctattatactcattttataaaaatataatagtttttttctctaaaccttctagatgaagaacactccaggaagatgccctgttgtcctattatggtttcaaatactccgggagaacctggctggattagcaagtcttagagccttctatcatctcaaaatccttcaggtttatcatttggctttaaattcttttttttttttttccaagatggggtttcactcttgttgcccaggctggagcacaatggcttgatctcggctcaccacaacttccacctcccgggttcaagtgattctcctgcctcagcctcctgagtagctgggattataggcatgcgccaccacgcccagctaatttttgtatttttagtagagacgggtttctccatgttggtcagctggtctcgaactcccgacctcagatgatccgcctgccttggcctcccaaagtgttaggattacaggcgtgagccactgcgcccggaccggctttaaattctttattacaaacagatcggccagttcaggtaatagcagcaatattcctttctttctgaccaattgtctcaccttaagtgccctcgagttcttctctctgctttgagagggttggtgagaatacatgacatgaagtctccaagtcctggcgtgactccaacaggccacgtgccacaagtcggaaagaccgaagttttttctttccttcttgttcttctttctttcctgcttctttttgaaagctcataggaaaaagggtctaaaagacatttgttctatctctgtggttttgtaaaaggtccatcttggaatgcagcttatttttagttaaggaaattcagagatcaattagttatatgttcgaagggtcaactccccagattagtcaaagcaacaagaaaggggataatggataaaatataaaactgccaaacagagaatctcagttgcctccactaggaaaggacttcccagaagatccactgcaacctcatccaggctttctccaaagcaggcagggcctctgaaacccaaatcctagatctgtactttattaattaagaacacaaataacaacaatgacaataataccatcagcattcctggagtggggcactaagtgcctggaactacactaagtacttcaatacgtagaacatcgtttattttatttatttatttatgtatttacttttgagatcgagttttgctaacgttgcccagacgggagtgcaatgggtgatctcggctcaccgcaacctccatctcctgggttcaagtggttctcccacctcagcctcccgagtagctgggattacaggtatatgccaccatgcccagctaattttgtattttcagtagagacagggtttctccatgttggtcaggctgctctcaaactcctgacctcaggtgatccgcccgcctcggcctcccaaagtgctgggattacaggtgtgagccaccgtgcccggcccatttaattttcacatcacccaacaagggaggccttactgctaagttgccacgccaggtgggaaagaggccaagactgtgaggtcaatggttgctgcagtggtccctgatttgtaccccctccctggatcgacatccttggggagttagtcctctctgacatttattctgcacgtggccatgggacttgcttgggccaaagggacaccagcaaacgtgcatgcaaagtgcttgcacattgtgcacattgggactttctcctttggctgctgttggaagcccaagaactttatgcaaggcagcccaggcccccctggcccagggtgggaagccaagaaatgagctggcccactgacagcccgtgagaccaggccacctgctaacacccaaacacaggcgtgagaccatcccaggtcatccagccactgaccaacctgaagccaccgcagacacatgagaaggcccagcagagattggcagagctggcccagagcagaactgcccagccgacccacagaagtgaaagcacaggaaaatggttactatttgaagccattaagttttgttttgttttttaagagacagggtttcgctctgtagccaaggctaaaatgcagtggtgccatcatggcttaagtttcggggtttttaaatacatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgagaaaacagtctttcattacaggaggagatcaaaaaaaatgaaaagcatgaacacagttggtcagttataaaacattacatagacaccagccattattcttatggataaactctcaatagccatcaatagaaggagtctattcaagtagtatagacaaatgaatagacaaatgattgaggagtcatttcatcttgagtttggactattagagaggcctagattattcccctccagcagggcaacaaaagtaagtgaagcctcctcttctcaaccttacttccaggcccccactctcctgctcacctctccctgagacatttttattgttcatctcactcagctgaacaacctggtaccctcagcttttaagacatcgacaaggaagggaattagcctttaagaagctcatgctaggttccaggcagtacatatgtgtatatgtgtgtgtgtgagagagacagagagagagagagagacagagtgtgtgtttccgttcagccttattatagccttttgaagtaggtattattaccaccattttacaaatgggaaaaccaaggctcagagccattaagtaacttgcagcagaactgagatccaaactcagggatttctaatcctaaggcttgcaatctttccacaaatgcctaaaagtgatactttatggatttgcctatttagaaagagagcagcgtttgtctgacaatatatcttgagtctcctactctcactcccatagccagcatctgtccccttctctgcagctccccacctagcccagtcccttcccctgaacagctggctcctctgattccactcctggcttcccctcatactccattactggaacaaaccagtccatgtcacattcatctcaaccctccctgcatactcggcacaggcacacagtcctcgccgtggcctacaaggtcttatgtgatctggccccagctcctctttggcgtcatcagcacccacacatctccttgctctttcccagacgtgccatgcctccttccgcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactgtctaccttatgtatctgtctgcccactagaatgtaagctccagggacagggtcttgttaatcattgtgtctccatcctatagtgtgccagccctcgcaggtgctctacaaatgcctggcgagtaaatgaaataacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacagccccaaacacttctcacattttgggacacccccaaggagtatgttactgttccctccccgtcatggtgaactctcacctccatctatgcccatgatgaagcgtcccacgatgagcatttcaaaggctcctgcctggagcgagcaggccatcagcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaagactcaggcacagtgcagggagcactggccttgccacctctggctgtgtgactgggttcagccctggggtctactaggtcacttacaaaggcaccatcagccttgacatctatgaattctctgtggtagtattttattgctttaattctaagactatcatttaacatttctgaagtcagtggtcatcttacaattcgtgagtcagggtccaggcaggaaaatggaaaccactctaggtattttaatggagagaatttaacatagggaattggttaagtggatattgaagaaccgagatgtcaaaaaggaagacctctgaagaaggggtgtttcccatgtggtgctgacacctcaggggcatggaggagggccccgaagacctttgagagtgggcactgtccactggactgtttcctctgaggagcaatatgattctggttctggaaatggacaaaagttggaagctggaatcaactgccaatgtcatcactgggactggcaggaaactcagacaaacatgaaaaagctagtcttttctctctcctctagtgcccctattggcaaaggacaaatgggggtgcaggccccagccccagcatcagagagagagagcccagaagggtaagtgtggagctaggagacaacagcttgacaaccagcatagcgttctacaacttttgttggctccttccctccctccctccctttcttccttatttcctttcctttccagtggctcataaaataacaatactcctcagacccaatggcatcttagatttgatgaactacagtactaagtgaatggctggactaatcctctcaaacaagattagggaaatttccatggcaataattattattaacagctctgtgtcaggactgccatcacttttataaacacatgcctaagacctcatggttcaaatacctgacttgtttggaggcctggggacctggattcctgcaccagctctatccttcaggagctaggagactttgaacttcatttctctgtgttttcttttcctcacttttgcaaaatgatcctaaaagcccacatttattgaactcttgctataggatagaccctgctttaagtactttgcattagtagctcatttaatcctcagaatgacccaaagagataggtactcttataatctctattttataaacaagttaactaggttgctggcaagctagaaacttgttttatttttaatttttatttttgagacagagtcttgctctatcacccaggctggagtggattggcacaatctctgctcactgcagtttccacttcccaggttcaagtgattctcctccctcagcttcctgggtagctgggattacaggcatgcaccaccacacccagctaatttttgtatttttagtagagacggggtttcaccatgttggccaggatggtctcaaacttctgacctcaggtgatctgcctgcctcagcctcccaaagtgctgggattacaggcgtgagccactgcgtccggcctagaaacttgttttaggtcatatagtcagtgagtcaaggagttggggaaacatcttagccctttacggcttattttttttcctatagactcaatgagttaacagatattaaattgttttgtaaattgtggttaaaaaattattttgcccaatagagccccagtgggtctctgatcttagaacttgcgctcttcccaccagctaacattgcctcttgtcataaattatgggactcagttatggcagatgctattatactcattatataaaaatataagtttttttctctaaaccagcctctcgggagactggggcaggagaactgcttgaacccaggaggcagagattgcagtgagccaagatcatgccaccgcactccaacctgggtgacagagcgagactccgtcttgaaaaaaaaagaaaagaaaaagaaagaaagaaacatcagtgaggccagcctggctggaggcagtagggagccagggagcaagcagtagaaagtgaaagttgagaagagaaaagaagaactcagagagtcttctatgccaccataagaactagcgtttcccccctgggggagatagcagccactgggagattccaaggagaggaatgacaccggctaatacttgaacaagatcactacatcttgtcttctctgttgctcctggactgcaggggacaagtgtgaaagcagggagaccagctggggagctaccacaacaggtgagtcaaccactggtaatgatttggaccaggctgggagcagtgcacttagtgagaagtggtcagatcctagcatattttgaagagtgagttggtgggatttgctgatggactggacagaggtggagaggcatagaggagccaaggatgcctccaaaagctttggtctgaacccttactttggacatgatggtgtattttgtgctaattttaaaactgcatgaaaggtttgtgagaatgttaaaattatatgaaagtctgacttgaaacatgtgcaaacgggagtgcacactctctgggcaagtttatcatattaatatattccttcccaaaataaccctcagcctgacagcattgcagtgaggatggaaatgtgtgcaaatcctttgcaaagctgactcactgggcttcagagcaggactttaatcattgtttccatttgtttcctgtggatgaacagcaacataaacaagggagatcaattctgaaagcagaactccagtgtccccagaactccacctaggatgcctgattcattgtttttagcttctccaatagtgtagaatcttccccatgaaacccagaaagtcatcagctctcaaggggaaaaaaagaccaaatacaaggaagcatggtagggtgatgaggagattggagggcatgtcccttcagaagtgtcaaaggggctggagacatttcgcctggacaagaggtcagagaaagcaggagagccaccttccttcatgccatgctttaacttggtgcagagcaccaggacggattgggggaagacatagggaattctatttcagtttgaatttggaaagtacttttcattaaaccctagtagaccagagaacctatggaaataatgtatctctccacagacctttccagtaaatcttcagcctgactgggcctataagccaagatcatgccttgtttccacatccctcaccctcctcgtgttcatccgttcctgcatacccagcttgaattccttggctcatccctttaaatatttatatgcccatccaccccctttcattacatatgcctggcaaaaccccagctggttaaatctctgtctactgggcatctacaaagctcagcttggctggagaaaaacatatggctgtgttgtcctttctcacctgaaattcatgaccaccaacctcaagaagggttaaggctcccctgcactgagtctacagattcctggtccatccaacacccttctctcctagaggactatttcatatgttttctctctctcttcaaatcccctttttatcattctcagctgatgaccatgctttctttttcactgagaacacagaggcaatcccaagagacccttcccacatgccctctgcttgtatttctgcacctgcatctgtgcccagacacctgccttcccttgttttccaaccctggtgcaaaccatgtcctctctcacctgcgctattgcaaggttctcccaaccaggctctgagaccccctgataacagcacacctttccaaatgcaagtcagatcagttcttaaaacgttccactgacttcccattttgctcagaggaagagtctcaaccctcgcctgcaaagtcctcaggatctgactccaaatatcccatctagcttcctatgattatctctacactgacctccactctcatcttcaaagaagtggagcctcttcttgcccctgggcttttgcacctgctgcctcctctgcttggagagctatttcccagggatgagcgtgctcactcccttgcttccttcagtgctccctgcacaagtcaccattttagagaatcctctgaacaaagtggtgagctcttcaccctccccagcatcttctgacctccttgagctgctctgttttctacattggtccttgtcacaggccgaatggcacagtctgcatgcttgttacttggctgtgctccccgcttggctgcatgcttcaggaggacagggactttggcagctttgctcatgcctgagtgcttggcacatagaaagtactcaacagatatgtggtgagtaaataatcggatgagggaacggaaagtgtgcaagcatacaaggatgcttagatgcaagcaaggatggccacactggggagatgtgatagaaaaattcaagcatcgagcattttccacccatccttccatttatccaacaaatgtctactgcttgcctgctgtgtacaagctgctgtgttgggtgctaggggccataaatacatatggttcttacgttgaagggctcccttatcagggaagagacgggaacataatgaaatgagtacaacccaaaatgccaagtgacgtaacacagggaactgaaagtcctgtgtgagctcagagaaggccaatatttagttctggtagatatgtcctaggcagtgggggatggggttgaagatttcttatgatttctaaccctgctttcccggctcatgcgtctgtaataccaaaggggttgtgtccataataaaacaaaccagtgatgcagggacagcttgtaccattgaagcctcttgttttggatgtgttgactctttgttttacactttggaaccctgccgtcccgaagtcttctggtcttatctaccatgcccaggctttctccttatgtcccatcatgaacccaagtttccttcttccagagttcttgccattctcactatgcttagaagactagtcaagtcttctaaggctgggagaagcagggttgaggatcaggtttcctggctggctggttatctccctatcccctcagggattcccccagctcaatgaatgctggcttctaaaggctcagggttgactcttctccagaagattgacattggctctgaaggtggatccccctttcccagtgctgcctgcagcgagtgacagatgagtggtaggggtggatgcagcccccttacttcaagttgggtgactctgtggtgtgattatgccccagagctcccccaagtgaggctaaacttgaccagggagtgcagccttgcctggctccttcccctgctgctttctgctttccccaccttaaagattactcctgaagagcccttcctccacaagccatgtgtgcatcccaatccctgcctcaggctctgcttctgggcaattgactttctgagacaattccagcctgaaagaagaggttgtcagcagcacggtgtgttgctcagtcatggactaaactatgttcctgccccctggttgagaacccttgaacgcatgtaacctcgctcgggccaaggagattcatgcctgggactttaactacaatgattggaaggagaatttccatcaagctggggccatcttgcacctccacagaagaaactgcctgacaatgaagccaacaaaaaacaagctgagctgagaggtggagaaagagagagatttggatttttttaaggctcacctgttaaagccctaacccctaatgtgactgcatttggggacagggcctttaaagagataattaaactaaaatgaggtcacaaggaagcggccctaatgtgggatgattggtgtccttgtaagaagaggaagggacaccagggatgcacacacacagggagcacacagcgagaaagcagccatctgcaagccatggagagaagcctcgggaggaaaagacctgccgacactttgatcttggccttccagcctccagaactgtgagaaaatgaatgtctgtttgctgaagccactccatctgtggtattctgatatggcagcctgggctaaccaatgcatgcttgccacatacactgaaggctcctccagcaggcacctagagagacacagttattttctactactataaaatacagatgccttttaaagggttgaagtagaaaatgatgaaagcaaaaatagtccttttgacaacctgctatttccctggagtgatgtatgggatgcctgttgtttgtgctcaccgaacctccatccttcttctgggaggagttcctcaaatttccaccaagaaaccttcctgcctgtctccacctaaccatggcttcaggagtggatgcgtggtacaggcctggccagtcaacataaaatcactcatcattctcaaggcatttaagatgtgcttttttaaaagcacttaatccagagtgttagaatgttatttgccaggattttctaaccttggcactattcacatttggaactggaaaattctttgctgtgggggttgtcccgtgcattgtaggatatttagaggcatccctggcttctcctagatgctagtagcacccttgagttatgaaaaccagaaacatctcctggcattgtcaaatgtcccctgatgaggcaacattgccctctggttgagaacccttgaacgcatgcaacctcgctcaagtcaaagagattcatgcctgggactttaatcacaactatcggaaggagaatttccaccaagctgggcccatcttatacctccatgggagagattgcctgacaatggagccaacacaaagcaaggtgagctgagaggtggagacagatttggattttttaaaagctatcatctgagccactggattcaaccaagttatattttagttattgtgagccaagtaattcccttttgggcttcagccagtttgctttgggttcctgtcacaggcattcaaaaagcctccttagtgacatgagacactgtaaatttgatctcgttccaccctcatagctgctccctcaggtgggtttgtttatctgcactttacagatttaaaaattaaagggcatagcagctgcctcttgtatctctaccatccatgcacagcactgctcagaatcataaagacttacataatgaattactcaggggctgcctcctttgcccaagcatcaccttaagccccagatgttgtgtctttcttgttcactgaagccccagtgccaaaaacagtaccttactccttgtaggtgctcaaaaatgtttgtttggatagatgaatatggttacgtggcttgtccaagagtctggcccaggatcagatttcaaagcccatgtgtgttttcctatagtttcttatatgttttttctgctttgctccagacggaagaaccagatccaatgatatgtgtaagaagaataatttcagtgcaattgaaagaacagatgcacaattgactctgtcaagtgatggaatgacccgtctcaaataaagccaatgaggttggtgatggtgaagatgatgatgatgttgatgatgatgacactagtgaacaaaggctgggcgaagagtctgggtcaattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggcccgtagctagtgtttgtacaccaaacatagtcactgtcctgtctcatgagggaaggagggtcctgtcactatggtcatgcaagcagaggacagaggatgctaaatgggtcactgagcttcaaccagaattcttgatcgctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagctaggaacagccccactgctggagcagccagtgaccagccccatcggaactcttccccacttccctggaatgtctcccccagctatacctttgagcaccttccactgggcctcccaggctgccattgcagtttcctctccctccctgagaatccccatgggagaggaataacagagcatcaggaaggcgtttcaaatagcatcatgtcacaggaagagtgttggcctgtggtcaaacacatgcagatctgaacttcagttcaactccattttgaaaccttggtccaattgaccactgggtcttggactcatcatttgaaaagtgcaggtaatgatgcaaacatggagttttaagaagtaaatgatatatgggatgtcaaggacaaggcaggaggtcaatagatggtagctttctttttcaatttttgctccttttctccccagcagagttgctcttcaagctgaaacttcagcccaaatcaacttttactctcataatgatgaaaaggaaactggcagctgcttggggcataacaaccaacacatcctttgatctgatctttttctgcatcctcacttctttatgactcctccattacttagagattgaaggtattttcaaagttgttttctcttttgctttccttttccttttttttttttttttttgttgccatgccagtgagggtagtaaagctactttcattgccctcattttataggtaagaataatgctggctgagaagtgaggtgtcaaagtcccttgtaacacacctgatacacagcagagtcaggacttgctgagccacggcattctgacccgattctagtgttccttttcctattccatctgcatgggttcagagcctccttgaggagcagccttggggtataaatgccacggtcaggtataaagcaaggagacatcacaggccagatcctggggcatggggagtgactccatcccactaggacaagcaagaggaccatgggcagggtctggcttgggcaggaggcttagtgaccatgcctcagggaccctggccagtgatgccaatctgagtgccagcctgttgtcaaacagtcatggttttacagtacattcccagcattgggaattggcccctaactaagatctgcttggcatagtggaaagatcatgattccagcctaagctcagccacagtgcaagctagctaagcttgtgcagatgccctcacctctctaacctcccattccccatctacagaccccacagcagatagaaaattaaacaagagaatgtgtgagtggctggaaccttgaaggacctcagacaatggcatctctcactacatcatgcagtagttgtatttccaggccctgaattcccattaattactgctctgaaagtgggcttggggacaaggaaaatgtcagcacctcccctacctcacaggtatcacagaccctcataagcaccacttggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggccccatcagattgatgtgacgactcctccatcacttggagaagctctactctttccacacactgctcactggctcccaggatgctgttgttatgaacaagaatacagagaaagcattgtttgtggggattcattgataagtcaatctgctctgagagaaggattcctgtctaaaataagtgaggaatgaggctcacaaggtcaagtgagctgattggagagggcctgggtaggaaaggctgatatgaagtttttgattctcactgcttccttatttgtaatgtaaatgatctgaaatgacctaaatgtctctcagtcagggagtgtggctaaataaatgatgagacagccatatagtggaagactgtctaagcagtcaattttctggaaaagcagatctgtatgtacttacgtggaacaatttccaaggcactgcactgtgttttccatttgccccaacacccagatcaattcccctcccctccctgctctgctctatgccccgggagcatctcctggatggcaacatgacttcctggtttactggctttcacatgggtgtgaccagtgtgcacctctgcagcaggatggagggtgggaggagggaggggtcagggcatttcttccctgctcctcccccatgtgggtgctgtggctctgacacagcccagtccctatacgcttctgctgctgctcatcagcctgcagtccatggcttcagttatctttggaccttggtctctgatttcttcccctttcccctttgggcatttgaatctctccagttgaactgcctgagtggagttctgttgcctgtcaggaccctgacaatgacacagatatattatgaacatggagggcacccccagatagagacagcctcctactgacctcccaagaacctttccaatcatcttcacaattaacgtccccacaagtccaccgatggcgaatatggacacagtcacagaccagagcaaagtcagagtgtctgggtctattggacgtccatgccttctttcccatgactcattgtaaaaggccttgatgtactgaaaataaacaacaaaccatgttatttccttctgttctctcctgctgcttgaagcaagccagtgtacaaaacaaaacagcttgtacagagcattttcatgcatagcactttgctaatttgtttgagctttatctcattggcctcttctaacaaattttgggaagagcagaagatgttaatctttattatattcaaatgagcattttttttcttttatggctagtttttttgtgtttcttgcatctttgcctatcccaaggtactttttttgtaacaaaatgtttcctctttttacctcattttggagatagggaaactgaggctcagggagacaaagtgacttgctaggtaagtgctaaacctgggagctggactcagatctgaccccaagcttatgatgagcttcatagctgggcttctccaattctagtgcaccgcagcattgctgtggaggtgtgttaaagggcacataccgggtgggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctatctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaaggaaatacaacttcacattcactagagtctcatcgctgccaattctgattcagtgtgtttgggacagggactaggtgattctgatgtacaccaaagactgaggtccatggcactaagctccaaacagagttcagtccccaaggtacttagagttccctgttgctacccaacgtgagcccgcaaacctcagctgagccagtatatgacactgcagaaaaagcttaggttcaggtcgctcagacctgggctcaaatcccagcacaacttggtaatgatttaaatcagctgaaccttggttttcttatctgcaaaatgggaatgatgacattgacctctcagggctgttgtgagggtcaaatgagagcttgaagcagtggccagtacttgaatggagcttacacaatcccacatagactaaaaattaaaagatctggtaagactgaggagtgacaagcagtgtgttgtctgctggtaggagtttgacttgtacagccatcttggaaaacagctttggcatcagctagtcaaatggaagatgcctgtagcctacaactcagcaaatctacttctagaaaactcccctgaaaaactgtttctggggagccctaggatatatgtactcagatgtccatggcagcattgcacataataactccagacgagaaacagcccaggtgcccatggtcgatagcaggaataaacaaattgcagaatcatcatcatatgaaacatcacagccacaaacatgaatgaatacagctctgtccaaacacacatgggaaaacctggcaaaaataacaccaaccaaaagcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttctttttttttttttcaggctggagtgcagtggcatgatcacagctcactgcagatttgatcccctggggtcaggaggtcctggtacttcagcctcccgagtagctgagacagacgactacaggtatgtgccactatgcctggataaattttttttgtttgtttcttgtacaaaggaggtctcgccatgttccccaaggctggtctcaaactcctgggctcatgcgatcctcccgctgcagcctccccagaccttttattcttaacctggattgtgacatgagtgttagatttatactcagtctttaaagtgtgtgtgtgtgtgtacgggcacacaagcataatgcatatgtgtgtattttatatactcttttgtatgcataatacatgctgccatttaacatggaaaagaaaaatggtaggaaagtgttccaggcagagggagaattatgccaagacagcaggacagaagaaagcttgggtggccatggaattgcaaggaggccaataggggaggaacaggaccagaaagggaaggagtgggctggatgaagttggaggggcaagaaagggcaggtcatgtgggcctgataggtcatggaagttagcctggtttttacttggattctactctagatgaagtgggaaagtattggagggtttttggcagggggaggacatggtgtggcttgcattttcagaggatccctctggcaagtggatgaaagaggagctagacaggaagccaggcacacttggggggcactgcagtggtccaaagatcatggtggacttcactaagcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagcaaatggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccagacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatccaggtgccatctggttgcttcactctgctttccataattttgacctcatcctaagacagcatgcactcacaattgcaggatggctcctagtagcagttttggctacatgcttttctattcatgcatgactggagagagtaagcttggcctctcataggtctcttggtgctaagaggaactttcccggaagcttctaacaaacttctctttatgtcctgctggacatagttggggcacagatcccttactaaaccagtgtggaatgggacccatcagcctgtacctctgcccctgaattcctttcctttatctgttcctccctacgtgagtgaatgggaccaccattctccagttgctcagccaaaaaccacgaagtcattcttaactcctgcccttgatccaatctcctcaactaatccaccctcactcatccctgactgttagggttgaattgtatctaacctcacacctccagatttatatactaaagtcctaactccccaaacctcagaatgggtccttatttgaaatgtggtcattgcagatataattaattaagaagaggtcatattggagtaaggcccactctactccaatatgactggtgtcctttatagaaagaggacacaaagacagacacgggtacagagtgaattttgttcccctccaaacttcatatgttgaagtcctaacccctagtacctcagaatgtgaccttatttggagacaatctttacaaagcaaataacattaaaatgaggtcactagagtgggccctaatccaacgtgactggtaccctgataaaaaggggaaatgtggagatagacaggcacaggaggaagatgatgtaaacaggcatggggagaagatggccatctgtgagccagagagagaaggctggaactgagccttccttcaaagccctcagaaggaatccactctgccaacaccttgatcttggacttctgacctctagaactatggaataacacatttcagttctttcagtcactcagtccgtggtactttgttacagcagctctagaaaagtaatatattgcctagcttccaaaaggcttctcaccacttccaccattccaccactcaaccggtccaaactgccatcccctcactggggctaccaggacactgattcctgagccttcatcagggtgctaccagcagccttcagaatggccactatgttctttcttagtggctggacatttacctgacattgaccatttagtcaatgtcaaggctttatgtcctctattggacatttatctgccttttaggctccccagcatcagaagccctcttcccgcctgggagactttcctgcctcagaatcctgagtggggaaacaaaggacacataactacagaagccaaacatgccagacacccgctctcccagcatcctctgcagctggaagtggacatgtgaccaaggctcagccaatcagatgctggaactttgatcaaggtgttactggggctaagacatggggctgaggaggattctccagcagcagagggagctctggtgggattgggtttgggggcagcagcaggggagctgcaatgtcctgtgccagcggtgcagtcaatggcagtggtggctgcagcggagcccataggaccagctctgggagtgatttagggtagtatctccagctacagagcttccaggcctggctctccagccctcccactgatcctgtgagcaacccactcttttcaacaacttttttggctttagttgttccttacaactatggaaatacagaaactctagcaaagcacataaataatctcacttcaccctcacgacaaccctagtggtaaaagccctcatttacaaacaaggggcctgagagttatataacctgcccacagtcacggcttatatgcactgggaggcttttgtggtggagctgccaaacttcagggcacaaatacaactgctccacaaactgaactcttgaacttatgattaagatgtgaaagttaagcagataaacctaatggtgcatttattgatttaagagtaaatattggctgggtgcagtggctcatgcctgtaattccaacactttgggaggccaaggcaggcagatcacctgaggttaggagtttgagactagcctggccaacatggtgaaaccccatctctactaaaaatagaaaaattagctgggtgtggtggtgcacgcctctagtcccagctactctggaggctgaggctggggaatatcttgaaccctggaggcagaggttgcagggagccaagattgcgccactgcactccagcctgggggactgagcgagactccatctaaaacaaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcacgtgaacttgctccctatggcactcttatagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctctatagactctggaggggccagaagacttgctgcatagcctaggccccctgcaggaacacttttctcaaaagttccccgaaagctgtttgccccaatgcttttggcaactgaacgtttgtcttccaggtctgaattcagcaatagcccaggtgaaaggccttgttaccacaaggctgaagccagtgatgaagtttgctcagagaattcactgcactaacattccccaagcttgagatttgtgaacctcacctatggcaaaacatgactggtcatgcatgatacagaatgggtgcttaaataagaattcgttttgagtttctgctgtgtggcagtaaccatataataataaaacaggtaacccacacatcatagttacaatatgctctgtactattctaagaactggaggcatactgactcacttcttaccctccacaagggtactatttgttacctctgttttgggcagatgtggtatctgagccacagagccacaaggggccctcccaagctcacaccattggcatgcgatgtcaccaggactcagccccagtgagcagggatccagagtccatctcttaaccattacttttttccaactctaagtgtagaaaatataaagatgatgatatcaatacctctgttttaggggagaagaggagacatggaatgaagattggttgactgctaagtatgtatcagacatttggatatctcatctcattcaacccttgtagccatcctgagaagtttcattcacaacagagaagtctggagtggagaaacacatcccacagccatgccaaagatggtagaactgcagggcctgctagacctcacagtgctctcctcttcctggacatactgccaggccaccttacccagttccttgcatctaggtggggccatatgactacttctcaagcaaggagtgtaagtacaagggacatgtgtgacctccaccaagacgctgagaatgtgtttgcctgctccacgcttgctcctgtcagctggccagccacagaggatctagcagaggactccaaagtcctagagaatggtggaaccacttcacttaaggaacctgggtccctgaatggcttcatggagcagagtgttcctgctcatctccttcaaatgaggtgatataaatgggaattttcactgtgttaagccactgagatacagggcttgtttattacagcagcaagtttgccctgctgacacaatcaacgtaactacagagcccatgccatcacaattgcactgtgacctgaggcttcaagaaggaggagagatttaggccaagtcatgaaggcttggagatataaacctttacctagagctttccttttatgtgttgggagaactcgatcctgtttgaagaaaacaatctgcaataaaaatttgctttaagatcactgtggtaggtaacctctaggcctgctttgggacatctcactcattcctatcttacttgggattccttgttttactttttcattcagccaacagccacgaggcacattcttgtatctttctatctgactttacaggtctgcttcctcactaccaggggcccagcttcccatcctttcttctagatacaaattctgctgtttcttgccttcaaggagttcaagatctagtggagacagtagtcaagtaaacatacaattataacatggaataaaaatgccatgacaataggaagccaagaaaggctgtggaatccaagtcaagcaagcaagaagggcagacggagtgggctcagttacaggacgacaggcagagttaacagaattcttgaaggtgcagaaaccggagaccacaggttgccacacaggaggtataaaagacgcagtgggttgaaaggtggcccagtagaaggttggaggctgcctgtacctggctttgcctgccagcctcaggagtctacacaaaattccatgggcactggggagccattggagggttttagcacggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttacggctagtactaactacagcctaaactgcaaacaactgaataaaaggctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtagttggaattggcttttttccactctcagctctgccacttctttgctgggtgaccttgagtaagttacttaacctctctgcgcctcaggttcctcatctgttaaatcattgccctccttgaagagttactgtgaagatttaatgagagaatgaagatacagcacagtgctgggtcgatatgaagtacacaataaaaaccggaaattggggtggttggtggtagtgttgttgatatttttactgctatatttgtaaaataaggggcctaggctcatttatttgtcagattcaagaatccatgaatcacttaccattatctcccaggccaggaacctggggaccaagcctctggacataaaattgaactctgcaattcccagccaagactggcttagagcatctccaaataataaaagaaattgccagacaatgggaggcaaattacctcgtagcccgtttaacaatattaatgtgccttactgattcacacagagcctcccgtgaactcacttggaacgattctcaggagtcctgtaaaaatacacggaagtaacacttggtagctgggccagagtacacacaccattgcataagagaggaagtcatgccacaatgccttagggctttataaagacagtctgcaccactgaacacactggcacagggaagaacgcagtccagaagtccttaaaaaagtacccattgttgaaccaggccctctgaagttagggccccacaagaacaaaattccacaatcccagcagtgctacctaatgtcgcctggctccccgaggtaaggcctcctgtgtagaaaagagctctcacagcacgcctgagacttctcttcctagaaaagcctgctgcagggtaagtcccgggcttgcatctgggaacttggatgttggaagggttgccaccgttcccagatctggtaagagtgactcagtgtacctaaactgtgcaaacagtgtggtttatgctgtctcagtgtggtttatatctgctttctttctgggaatctggaattttctgcttgccaagcagagagtgcctatgtgaccaccccccgagaaaaaccctggactccaagtctctaatgagtttccttgttagacaaatttcacaagagttgtcacaactcgttgctgtggggatgaagcgcgtcccgtgaggctctgctagaagagttctttggagcttgcccctggtttcctctggacttcacccctgcacctttttcctttgctgacttagcattgtgttccaccactgtgatcagtcatagctgtgagtactaccgcattcctgtgccaacgcctgtgactcatgccagtgaattatcctacctgaaggtggtgttgggtgaccccagtacacctcccttgtcctaaggaaaaaactcagctcccattttggcttgacttgagcattaggtttgcaggtttgtggtgttttttcctcctccccaagtgattctcccagaggagcctggctgactcactgggaaagaggctcctgtgcctccagacacctgagactattttgttcccacagttagctttcagaatgaaatgaaacatgatgaaagaggaaacatcaattacaagcaacagccaggcaagtaaggctttcagagcctcctgggtttcccctcagccacctttgcagtgagggggcagccaaatgcttgggtttaattagttgaaacataaagaaggtaagtttcattgtctatttggccccaggcagaagcagagaagtgaatgcactcccaatattattcttattcaatcacagtcctgagccttcctcctgctggaacattcttttgagaggttgcatagctgtgtttacagggaacagtgcattttcgcagacttgagatgatattttgctctcctttttgcatatcctccggttggccggaatgaaaagggcaaattgttttcattaccagtcaattcacttctggatgcttgaggtagcaggggccccgtctgcaacatcaattctggaataactcatttatagaatgggaataagaacccctagcttgtagatgaggccgccagaaggatgaaatgaggtgtgtgaagtcccgagcatgatgtcagcatacagcaggtgctcaataaatttcagggtcttcccctatgggtcagaaatagggtgcttctagtttcacttgtctggtttgttcacaccagctgtgcaactccaacacagccctccaagtttccctacctcccatcttgctggatcagctatccccagctctctggctgcagcaaccactgcccccactgcactaagctgagcttcctggagatttgatgggaccgagttcctttccccatttggctcaacaaaggcatttttcttggagaaactttatgaaatgagaaaattctatatcaaagaggcaggctgtccagctctaatcgctgggacctccagggcatggtgcggggggagttggcactcacagcctgggacacctggacaccaacgccccaggctggaaaaggtccctgggccctcatcagtcagcagctgtgctggctctgatcaaatcaaaccaaaccaaacaatgactcacagatcccaatttaaacaatgcagcagcatctcatattagagaaaaattggaaacaacctcagaggcccacattaggaagataggacatcacaggaggcagctccacactgctgttaaacatcctggtgatgcagaacttccaatagcatagaaaggtgcttacaaataaatagtaagccaaaaaagagagtattaaacagtatatatgatgatcttcagaaaaaagagtggatttagatgacacattaaaagcggcctctggatggagtctgggttttgactgtgttcaggcccaagtgtaccatctattagctaggtagccttaggccagtcactcaatctctcccttatttgtaatacagggttatcagcataaatctgccatgtggggctggtatacaaatgagagagatcatctctcactcacagaagaatgtttgtatgtgtagcttcattatcaaatttctgtgcggtggtttttttttttttttttcctaatggaagtctgttgcttttatagttactgagataaagtgagacaaaagcaagagtaaaactgaaaagagcggggggtgaggggacaaaactctgggattcagagatacccatttcatagacataattgcccgttgtttctgcagtgacacaatgcacagggtcctcctgtaatctcagccctcttccaccaaagtcttgagccctgctatgcctccccctcaccccaaccagaacttatgtcgtttgacacagtctctgctcatcattccctcctggtttccttgagaatgggtctcaggccacaccagaggcacctgccaggcgacatgcttctttctctaagagcgcctgggttcccagagcagcctgctaagatggcattatggggtgggattaactgaaagcaccagaacttgcttttgggttctctctctgttggttcacttgaatcttgtttgatcaggttctaacatctgtggctaactgggcagctctacccttatagagggaaatgttgattttgctttttattatcatttgtttatctgcctttagggaaggagcagacaggagaaaataatagaatataccatttatgctgggaaatgcattgagtcaacttaattgctctacagaaaccctgggcttaaatactaacaccatgaaggacaagagtctgtgtctcccctcccaagaagacaaaacatggctaactcaaaaaccactggaaaagtgagtaatttcttatcaaagccaagccattcagtattatttctgtggctgccagtgttgtttcaaataagtcctaatttatattggatggtgtggggccaatgagttagactcctaaagttaagttctcattcattctttctcactccttccttctctcactcactaattcattttacaaacattttttgagtattttctgtttataatatgcatttgtgtaatgtaaatcttatatacacagtagacaactgtataataaagtttggctggcctttgtccctggttcttgggatgtagcctgtgaattcttgggatttcttgagttattcatggcagacctctcagaatcccttgatagtgtatgttaacaagataactcaggatgggggttggccatgcaagaaagaccagccatgtgatagagggttggggctttgagccaagtgacatcagccctacctccagggaagagaggaggaccaaagattgagttcaaccttatggccaatgatttgatcaatcacatctacatgatgaaaccccaataaaaatttggaacactgaagcttgggtgagcttccctggtagacaacactctgtgggaggagagagaacaccagagctggaatccttccagaccttgccctgtgatctcttcttgtggcttattctgattcgtatcctttttgctataataaagctgtaattctaagcatagcacttcctgagttctgtgagtcatttgagcaaattatcaaaccagaaggggtagtgagaacccccaaatgtgttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgcgaggtactttgatagacgccagggaaacaaatgaacagtattgttttaggtgacactttgatctgtacaatcctgactgctatacttttgccaagcctccaagcatttcccccaagctacaggccagaaactgcacaaacaggcaccaagttcactgtctacccttttgattagccctgaactgtcccgcccacctcaccttctgttcccccaaccactgcattccctgtttgctttctaatttttattttcattcataactcctattcaacacattcattatctcaactttggtccttttttcttggcgacttttcttaatgtccatcccccagtggtcgttctgcctaggctgactgttctcttgggctcattgcaatgtgggatcctcctacaatcataggaagtgcgtgagtcccaggtcaggaatccatccaggtccatcacctcaatagttgcttctcatggatcagctactcttgaacccctcaccctttggcttgttttttgtcttggttgggcccttttggactgaagtctgggctccatactgtcggccctgccacagaccttgcatttctttagaacattgcttccagaatcttcctgtaggctctgtggacaacacccatgagcaagaggagctttgactcatgctttgcccaggcaccaccatcccacccaggcctgtatcagccctgtctgcccatttcagtccccagagaatgtcccttggggctcagaaccccccactccagtctgtgggtctccatccagcccttaacaacctctcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgttattggcacataccctcacccattcatttacatatcatctataactgctttatctctacatagcagagttcagtagttgcaacagagaccatatggccaacaaagaaaaaccacgcactatctggacctccacagaacatttgctggaccttcacagaacgtttgctgattcacagaatgcagcagatcagcctagtggaacagaaagaagggatactcaggaattagacagaccagtgtccaagtccccatctgtgaacatggtggaggtggtcccagaagttttccataggacagactcacagctggcaatttgtttgagagtgaagagacctaaggacttgccttggactcactttaaatttaaatttatccatttgctcatttagcaaatattttttataaatgcttacaatgtgtcagacattgttctaggtgctggcactgcagaagcaaggacctttctaaagtgaagggaaggaggacaagaagtaaaggaatatgtcatatctcaggtagtgttaaataccatgaggagaaataaattcggtgagggctaaagcgtgatggaggggtgccattttggataggctggtcagggaagacatttctgaggaggggacgtctgagcagaggcaagaagtaatcaaaggagagtgcacaggaaaatcaagggaagagcactgcagccagcaggagcagcacgcacaaaggctctgaggttccagcgtgcggtgtgtttgaggggcagcaagtggggagaagtttgtgtaaatggagaagagggagtgaggggggaaatgatgatgacagagtggtcacatctgtcatgtgtcatgtgtcacggccccaggtaccgtgtaagtcaccacagtctggcttgctttctagatatagtgggttttgagcggagggacaatatgatcttgcttcatttgtcaaggatccctttggcctttgggtggagactaaactgtaggaaccagagtggaaacagagaaaccagttagggtttagtgtagagaatgaatagagcctagctactgtggtgttcatcttggtgatcaacgcaccagcacagcacagataaccctgattttcaacagctaaggacaataagaacctcttgccagttcatgcaaagtccagtgtgcgtttaatagttctctgccatctgggggaagaaaggactgaagatctttcttcagtgctgccataaccagggatgctgccataaaccaggcctcatgtggcctatcagcacctctgttcacatcccatccaccaagctggccaaggacccttgtggatgcacgaggtgcaggtgttctcttccaaatgaggcatgaaaagtagtcagatcctggggattcttggaaagttgggtggccaggaggcacatccaggtgactgtgttgaggagaagccagtgggaatgtttaggaagtgtcccacccctgaaacttggatgtattgggttccctcagcctcagtttcctcgcctttaaaagggggttagtgatagctgccttgcaatattataacaaggatccagtgtgcacacaattctgaacctgggtcaagtgcagagctggtgcccagaggcgagttattttcattttcggcattacagaaagtttccaaatatctgaggagagaggagcactgagcgtttttaaggttgaggctgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgaggacttacaagcctgggccagtgctaaaggcagcacaccttcccatggggcagcatccacacaccaccccctggtggcagcctttgttcatcatctctgtgagcagataccctccccgcactccaaagcagcactaatatctgcacctcttctgttccaagggtttctttctccttctcgagagcccagcaccccaggtgaagcctagctctcacaccctaaacccctgccaggcttgggtccttccagcctgtgttagattccattccttagaggctctgctctgttcctggtctccctggttctggggctgcctcactcacccgtttctaagcccactgcaaggagaagagagaattcgaggtgatcgctggacgctgggctgagctcctccagcatcacatctcctttcatttcgcagcgacctcacaaggggctcgacaccagccctttacagaggcacctacatggtgcctgggattctctgcaggattctgagctgggattctgtgcaggcctgctcagctcacactcagggcagtttccacctcggaagggcctcccagggcgagccttggccctcagcctgctcatagcctgggtggtgctggatcatgctcctgttctggcctctgcaacctttctgatctggcttcagctcccctttccagcctctacctctccaccccactggaccccacatccagctacccttaggtctccaccattcccagaaagccttgagctctctctttcaagccccagtgaggccccactgacctccccaggtagaatacagtccttcagctgtcctgtggctccatgcagcctgtctcactggtgattatttattgagcctctgtcactgctgctggtcttggggcacctcgaggacatggatgtgtgtcgttttcatctttctaccccagatacagcaaggtcaacacccagggaagggcactgaaggattgcctgaacagctacccctctcttctcacaaagcagcacaagtaaacataaaacatcaggacctttaggcagagcaggaagaggttacatgaccccaaaccccatagggaggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgatggcagcatcatccaccttatgcttgagcccctagggttgttgcagtgaaaccttgctctgtcttttggttggtagatggacaggtaagtagccctgggcttgctgtggctcctcccatctccccttgttcctctttgcctttattgatcatgccaaactccccccatggctggactgttggcgcctgccattagtggtcaggggcaggaaggaggggcagagagcatggcacggatcttggattcagacagacctgggtttgaattccaacactgccacctcctggctgtgtgaacctgggcaagttgcttaaactgagcttctgtttctttgttcatgaaatgaaggtaacatcagtaattaactaccttgacctgaattgtgtcccctccaaaaatgttgcatgacatttttgttgcaaggatagggcatgttgaagccctaaccccgatgtgatggtatttggagatgaggcctttgggaggttactggggttagcagaggtcatgggggcggcctcatggtgggatgagtatcttgctcccttgcactcttcctccctctgccatgtacaggcagtgagaaagaggccgtctgcaagccagaaggaaggtccttgccagacaacgaatccaccggcactttgattttggatttccaggttggagaagtatgggaaaataaatgtcttgctgaagaccccaggctgtgctgttttgttacagccaaagacactgacgtctctgtatttctgagaatggaatgcgcctggcatgcagtacattttggcagagttgatgagctggccatcacagtctctgctcctcttcaaaggcagagagcacatgctgggaagtagctacccaactggggatgacacttcccaggccgtggatctgggcagatggctcagtcctggactcaaggcctcctcggggtgcttgctctgggctcctctaaagtatgcatgacgagccgtggtctcgaggttcaaaggacaccaggctaaaaagcgccttgtgatgtctcaagactgaacaccttgctgcgcatactggccacagaggtagagctccgatatcccaaacaagaagtcccatggcctaacactgcctggcacagaaaggatctgttttaaaaatgactgaaaatgtgtctgatgcctgggaaaccagaagcccgcccagggccaaactctggctccactcattatgtgactgtgggaaagtcagtgaacagtgtgcctcagtttcgtcatctgtaaaatggggataatgatgatccatacctcacagggctgtcatgagggtgcactgagctgattaacgcatgaaaagtacatggaggagggccggcacctcatgagggctttttccatctgtgctcttactgatgctgccataatatgtgtcactcatcttaagaacggtaaaggccaccctggctgtgtagatcttcagaaatctcctttcccgaaacggagggagggcacgttaaactctctctgtttggcttaccatggtctttcccattaaatacctctaagctctggcccctcctgtccttctcactgacaccaaagttgtttttctaaaaaacagtgagcatattaaataagtaaataaataaggaggcacgtgttctcaggacctcctgagggtgtgtcatggttaaagaaaaataaattttaattaaaaaaatgtgagttgcaaacccccacccccatgaatctgccatggctccctactgcccaagactaaaatcctactcctcagcctaagatcttaggccctcttcttttgactccatcctgcttttccacctcttctttcatcccagctctgcattccccctaggtactggcacatcacacgctactaacttcctaatatgccaccatgtgggcacagccaggcctctgtgtgtgtgcttcagctccccacctccctttgacacctgtggaaattctacacatccctcatgactcagctcaaataccacctcctccaggctgtcttccctgatccccagagttggatacattataaactctcaacaatgcttgctgaatgaataagtgagtaatgggattcctccgtcctcatgttcccatagtcagtgcttgaacccatatcattctatcccaggtgtaagtttcacataactctgctccacaagccatgagtgcaaaggttctcccccacctctcacctggatgttttgatgaactttcaagatgaagcaagagtccaaattcctagccctctttcaaagacaaatatcgacaagccagatccccatcttggaatgacgtcacaatgacaaaatcaaagatcactgactgttggcagtgcttactgaagccatctaggccccctggttttcaaacagtttttagcaacagaaatgaacaatgtcaaataattaacagactttttaaacatagaactgacctgcgcaaatagtgcttagatccgtgaggcacctctgcaaaattccagggctcatgggaacctttgaaactcactgacccaggcttcccctatgttttgtacacaaggatgctggactcccaagcaaggaaaagcctggaaggcacccagggctgtcctcagcctgcttcctgtctgcccccaaaacagcttgtgctccaagaacctggagctccccgcatttccccagatgtgtcctacatccgtgtccccaaaacggcctgtgctccaagaacctggagctccccgcatttccccagatgtgtcctatatccgtgtctccaaaacggcctgtgctccaagaacctggagctccccgcatttccccagatgtgtcctacatcccggccccccatccatcactccaccttccaaacttagtcaggcatcacttcctgcaggaaagcttccctcaagcctccaacctgcccttgcctgtgggtggtggtaggtcaaagccaaagccagcacccacaggatagcatctaaaccttacagcctaggtaggcagtacccaacctttaactgcaaaccagaggcacaatgtgaagagggcctgggagaattgcacctggatctgatttcagagtaaaacacaagccaaagatgggtcttatccagcagatacctgagtggcctctggttgtaatttaaagtcaacaacaccaggccgggcacagtggctcaagcctataatcccagcactttgggaggccaaggtgggcggatcgcttgaggctgggagttccagaccagcctagccaatatggcggaacaccacctctacaaatacaaaaattagtcgggtgtggtggtgcatgcctgtagccccagttactcgggaggctgaggcagaagaatcacttgaacgtgggaggcggcggttgcagtgagccgagatcgcaccactgcactccagcctggtgacagagtgagactccatctcaaagatgatagatagatagatagatagatagatagatagatagatagataacaacaacaacaaaacaaatcaagaaaatgtccaagtttccatgcataaggcccctcctggttctttccccggcattaggggccagaggatcgccccccaccccaccccgggacttccgaagccccctctcatctagtctcccaacgttctcccaggacacccgccctccagccgcaagaactgtcatcccccgcccctgtccccgtgtcatcattgtctgtctctgtgcctcccctctcccccgagtgggggctaatctctgtccccgcggtgtcccgcgccgcgagcgcaacaggagggggcgctggagcccagggcccttgcgcacccgaaggtttccgcagggccgcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggaagacctggaacgttccctcagctgggggaggccttccggaggagaagtctttgtccttggctggggtagagacagagagaagagacgcaagttggggacctgcaagtagggttccagtccaggtccgcgtgcgcaggccgggcgccctcaggtttagcggccacgcccttgcgttccttccgggttgcgtgaggattcctgaaacgcagttttcagcagctgctctgggcagctccacacgatcctttcagcgaagttggcgagtgtccgacccagacagaaaaaagcaaagccagactccaagcgctatcagccaggcgtgattctaagcacttttctgcgcattgtctctgagtccttagatcagtgctgttatgtcctgtattacaggtgaggaaagaggggcagggagcgtggctggtgctgtctaggatggggactgaagtccaggtggcctggctgcagtgcccctctagtcaccactgcactgtcccctgctgacccgtcacctgagtgccgttgtccaagggcctgagactgccgacagccagacagatgtgcacacacgcttacatgcacatactgttccagtctgaggcgtcaaactacaggggctggtccaagcctcaggacaaggacctgcagacgtagagatgcaaggtttggcacagagaacagggcgcctgccttggtgttgtcctgccctgcagccccatctaaggacagccaccaccagtacagggccatagggcagaaacacctggatccctggcaaaggctgacaagctggcatgagccagggcaggagggatggctgtcctcagctggtcagggaatacaggccaagtggacaggggccaggtgctccggaaggcaccttctttgccatcatttgacatatttgtgagtgtgtgtgtgtgtgtgtgtgtgtgtgtgtgtgttgtaggcgccaggccctgacaaagctgtgggggtgcaacagtgaagaagacatatggatccatggttcagggacccatatcagtcaaatcccgtctggaagggaatgcgggtctcttgatggccacttacctgctctgccagtctcgtttgtctcctctagtgccaccagccacgagatagagctttggggctttgagccaagtgatatcagctttacctccagggccagtcccctcagctgtaggagtctgagcaagtgacttgacttttctggggctcagcttgcccacctgtgaaatgggatcttaatagcagcactggccacatatgttgttgaggagcctgctgcagaggaggtgctccgtagaggctgctgatcacatgcgggggcaagagggaacatttataagccttggggatgggtgctgccaattgaaatgtagtaccagaatatttttctgcagtgagaggagcttgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgaccttagaggacacaaactcctccctggtctgcaccccatcagattgggagcacctggtgtgaagtgcccctgccagaggctggtgaagggcaggtgggggccatcttctcctgcctcagctgtgctccccggagccccctgcctgtgtggcccgcctgtgccctccacccgctccccactcactgcacgggcagagggtgcccactgaccgacggtgctgctgcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctccctgcctcaaagccccagatcccccagctacacgctgccaggctggggctgagcactgtcacacggctgccacccaggcctgccttccccacagcccgccagccatgcagaaaagctgtccgtagttacctttcttctccttccacctggcaccccactcctcaggtggtcacactccagcagtgccctccctggccctggaggcccggcgtggctggtgtcatctgtgaggggaactaggcccagttccttggaattcctattttgtttccttgccatgggtctcagtgacccagctgatggctcagtccagggaccccagactctgccaaggcatttccgtgagtgaggaggcagagtccactggaaggagggcgggagttcctgacaggaagtgtggcaatttgatcatgcctgaacaggcaacggggcaacatttttttctctgctcctaagttattacagcaatgaaacagtccaaaaagggaaatctgtcctctccaggattgccacccagggggtggaattttttttttttttcttagcatctttttatttttctctggtaacaaagcctggagcagggtgactgccattaacctaggatacctccctaatgcttggaacagaatggagaggtggctgactttgactcagaagcctgcatacagctctgcccctgactcttccactttttttttttttttttgaccgaatcttgctctgttgcccgggctggagtgcactgatgcaatctctgctcactgcaacctccgcacctgggttcaagcaattctcctgcctcagcctcccaagtagctggaactataggcgtgtgccaccacgcctggctgatttttgtatttttagtagagactgtgtttcaccatgttggccaggctggtcttgacctccttacctcaggtgatctgcccacctcagcctcccaaagtgctggaattagaggcgtaagccaccatgtctggccaactcctccactttttaactgtgtgtcctcaggcaagtcactttattctctgagctgcaacttctaccactgcaaaatggaatattgaccccactctgactgtcctgcagacttattctgaagctcaaatagaaaacagccagccccaagtggcgtgctgtaaatgagtgtgggctctcctgtagcctagaacaaaggcgagggctgtgggtttggaagaaaaagaatttgcctcttagtcgttactctgtcctgctcattcagcactggctgaggggacatgtcctgtattccagccccaggctggctcaaggacagtactgagaaggcaagggcctcatgcacaccaggaggttgtgggaatcagttcatcacatggccatgttgcctcagacgccagagaagcaccttcaattttggctagaacagtttgctcccagaagcagagagcagtgcagagtctgggccagagccagggacaggcttggtgaatgcagaacgtccaggaggcaaggtagggctcagtccacaaaagagagatcgaaaagttagcaaagtacgtttagtaaaaagcacacaataaaataaaaggtgtggagtacggcagacattccaggaacctggaatgtgaaacgcacgtggaaacgtccggccctgacatgcacggtggtgggaatgtggctgctcaaagcaagtggggaatcaagacttccaaagaggaaaaccaccctcaggagttaggttggggatgtattgagcacgccagtcattcagtgcaatcgtccttctgtgtgttaatcagtcaggcatgccccgggagaagtggctgtttcttgaactggatttcagctatgcagcctggtttcctcattgagtggtgggcctagagcagcattctgatgtgcaaatccttaattataacatgacctaaaaaggcggaggattccccaggacagtgtggaggaggcaccacatcaatctcagctggatcttggagaccccgctggaagaggcggcttctgagcggacagagaaggatacggggtgagaggacaaggagccaaggcctgcaggcacagatgcctgcagtgtgtgggaggaagtgaaattgtcagtgaagcatggttggggcctgaagtacaggagatgggcagaggaggggcagggacagctgcatccctgtgcatggagggcccctctgcccctatgctgtcctgatagggactgcattttcatcatctcatttacccctcctcatcccattgctgtgactcccctctctataccctccctgtttcctcatctgtaacagtggggacctcaccagattttgctaaagctcaaattggatcaggtgtcccctcatcccgttaaaaattgcttcgtagtcctctgttgggtttgaaaactcaaaaggaaccagaaattaggcagtggacatgaatgtgcagctacagctggacagaaagtaaaagagcggagatgggtccctcccggatccagatggtagctaaccagggttcctggtagccacagcacttgcctcaccttcagctcctactacatgtgcacagctcatgttacatgtgcacagggctttcccaagtgtgttcaccttcatgatatcgtttagtcctcagaggaactatcagacctacatttcggggcaactgaagttcagggggagcatggaggagcctgcctccaaagcgagggctggttccccattccacagggccatcggccctgcactgcaggcaactgctaaggaagcgactcctatcacagatgaagtcataagacaaacatccccagatgttctgggctggggcacgttctgcctgctctgacactcactggttccttcattcagtcattacttgcctgtctttatgaagctcctactcattcaggttctcctgaccttgctcaggccctcacttctgactgccctgaactgtgctcacccttcagcacttaactctctcgccacctcctcccagcagcctccccaacctctcgctgcctctgtgctccatgtgtgccttcccctctgcacgtgtgctgctgctcacgtgtgccttcccctctgcacgggagctcactgtgggcagggatggtgtgcgtctcaatgggctgattgtgtcccctcagattcacatgttgaagtcctcaccccaagtacctgacaatgtgactgtatttggagatagggtttttgaagaggtaattaaggttaaatgaagtcatatgcatggggctgtattccagtatgcctggtgtccttataggaagaggaaatgaggacacagacacacacagagggatgaccacgtgaggacgcagggagaaggcagccacttctgccaagaagggaggcttcagaaggaactaacctgctgacactctgagcttggacttctggtttctaagactgtgagacaatacatttctgttgtttaagctgcccagtctatgggactttgtcttggcagccccagcaaacccacagtgtcctaagcctctttgtattcctagacttccttcagcctggctcagggacagggtccagtagataggcatcacttctggaactgaccttaaactgtcctccggatgatttcctaaggctaaaaagttgtcttggacaaggtggaagttttctagcagggaagagttggaaaagaaggggggttttctattgagtatcatttaagcagaatgtttgaaatgactacatcccttccttcattacaccaaatacttagacagtagatccttgactcacctaatgtaagcaccaagaaaagatatagcgtccacttagagggaactgctgtctatttgacattattcttgcgtggggtcttgggtaacctcaaacaggtgactgcacccttatcctccatttcacacctctgtggggacaatgatgttcagcttgccaatttcacaccttcttgacaacttggtaaatggacttgtgttgatctctgtcctaccaaatacaggtttattataaatacaaataaattttccctggagtcacagtagcttccacacccatcacaggaggtgaggcacagataatccaaggtttaagaagggctcaaacctgtactagccacatagccttggacaagtggcttcatccctttctgagcctcagttcatcgcctgtaaaatagggccagtgatgccttcagcatggtttgatccagagagaaccatgtaaagagtctctctttaaatgagagccctatgtaaaggtccagcacagagtaggcactctctggctgttggttcttgaatcaggtttaaaaagagcatctgatgagtcccaagaagaaagaaagtcattctattaataggagctgaggacttcctggaggaaggggcaggtcgactaagctttgtgatggattaaggggtgggttttagtgtatctttaacgatgatgacataatcattgtcaacatcaatgtccccttgttgagaaatgacctttgtaatggagacttttgccccaagcccagaaagtcaccagcagatcaggactgtcaatttcactcttctgagcctcatcccagacactctacaatccccatggctccttcccatagaacttggctttcagctgctgctcactcttttctctgcccagcttcaccttaacagcctcccactgacccaggggaaaggggtactaccccctgggtgaccggaataatcatgtaagggagacagaaaaaaaaaaggactgaccaatttctttttcgctgaatcactttcttcatcttctcctcggtcctttttactgagcttcatggttcacttttcaggttttgaacttttgttgttattgtttctgagaaagagaaaaagaaagaagccattagacagctgctttctcagatgtgcaagtcaggggaggtggcctggagcagtcttcgaaaggtttgctgtgaggagctctggctgggatgccaggataggacacagcagcatcctcgcttgggcatctccctgctctcctctgtcctcagtttctctatttttgagtgcagggcttcccacacttgccttgttgattattaaatacaggcaatgatcccattcctcttctgcatcatcaatttatctctctgtgttggatctccccgggctatgtacaaaaatgtcctagtgtcacccatattttttttttaaaaatcaactaaaagtttttggcaaggatgtggagaaattggaacccttgtataggattgtctttgctagtggaaatgtgaaatggtttagctactgtgggaaaaagtttgcttgtttctctaaacataaaatcaccacatgacccagcaattccaccaccacatcgatgcccaagaggactgaaagcagctgctcaaagaaaaacttgtgcacgaatgttcacagcaatgatattccaatggccgagaggtggaaacagcccaagtgtcctccaatgaatgaatgaataagcaaaatgtggtctatccatatagcggaaaattactcagcaataaacagaagtgaagcgctgatacaggctacaacatgaatgcaccttgaaaacattctgccaagtgaaagaacccagacacaggccgggcatggtggctcatgcctgtaatcccagcacgtggggaggccgaggcgggtggatcacctgaggttgggagttcaagaccagcctggccaacatggtgaaaccctgtctctactaaaaatagaaaaattagccgggtgtgctagcaggcacctgtaatcccagctactcgggaggctgaggcaggagaattgcttgaacccaggaggcagaggttgcagtgggctgagatctcgccactgcactccagcctggtcaacagagtgaaactctgtctcaaaaaaacaaaaaaaaaaagaacccagacacaaaaagcgacatcttttatgatttcatttatatgaaatgtccagaattggcaaatccgtggagacagaaggcagatcagcggtggcccaggactgggggaaggggcagtggctgcagcagcctcacagataagcagcagttgcccttgggagtgatggaaatgttttggaactggatggaaatggtggctgtacaagaatgtgaatgtaggaaatgctgctgaattgtttactttaaaatggttaatttttccctatgtgattttacctcattttagaaaaaaacgtgtctttgatcccgtcgcctcctgtttaccaccccattttcctgctccctgttacagcaaaacgatcccaaagagaactcacttccccagcttccattctcccctcagcaccgcaccattaaaattgatctgaatgagctcatcaacaagccacatcttgccagaaccaacagtcaatttcctacaacctcccggcatcttcagtgaggttgacctctcctcttggtggtgcggtggtgccatggagcttctgtcacagtggtggcagcttctgttgcagtggtggcagcctcctgagtctggagcattggggccgagtgtcctttggtaatgggggtagaactgcctacccaggcattttttttttattgatacatattagatgtacacatttgggaggtacatgtgacaagttgatacatttgtataatgaaaatcagggtaattaggacagccatcaccttacatctttatctttacactagaagcattcaaattctcctcttgtaggtattttgaaatgtgcggttgattaataactatagttaccctgctgatctacggaacaccaggctttatttcttccatctgttgtatccatgaatccacctctcttccaggctgttttctgcacacttccagagcctggatctgcagcctccccattgatttgctcacgagcctcccattaaattccctttctgcctgggcccctccaggagggtttctgctgctttgaccaggaacccagctgcccaagcagccccttcgagctgccacaccaggccactctgccctcagctccctcatctggttgatcgggggtcccacaggaccaagcaatttcatggtgggtcagtcctgatatggatttgacaacttgggtaaagaaatgactgggagtaatgtgactcccttttcatgagaaaagcccataaatgcgaatgcagcactcgaggtcccctcagaatttcagtggttgaaaagtggagctggatgttctaagactcagaccctcatcctggctcctcgtttgatttaagaaggaagacaaggccttgacatccacactggctgaggttccaaccctgggtctgcccccagccagctgtgtgagctcaggcgactgagttaacctctctgagctcagcttccctacctgcatcacaggaaggacaacattatccctgcatagagaccaataataatgcatggacatcatacacagcacctagcagagacttgtaaattgtagacttttaatatcctaagtcatggtgccttctaggaaggggggcggttacttaccattctgcaatctgtctaaactgaaccttcctgcaagatgctgcccagggaacattcctgccaaaggcaccctggcattaggtcagagtgctgcctctgcctccttcctgtcctagggaacctgctggatgggctcagagaagcggtgcctcccaagcactaatcacagaacttcccccacagcatatccagcactcccagcattgcagcctctgtgcccctcaccgccctggggtgaagcttcagcccaatcccttccagccttcaaagtctgaagcactaatcacagagcttcccccacagcacacccagtgctcccagcactgcagtctctgtgcttctcactgacctggggtgaagcttcagctcaatcccttccagtcatccaagtccaaatgcctgatgacatcctcagagggctgacatctgcccagtctcctctattggacagatccacagggtgtctctgtttttaactgggtgtggccttgacctttgtaagatgagcggctcctgaatgccttccagacgactaggacgaggttggctgacgaggacatagattttctaggctcaactcttggaattctcatttaatggatctgagatggggcagggcatctgaatttcaccaagcaccaatctgccctatccccgatgcacagtctccaaccaaaccattggcttctcagtgcctcccagactctagccttggcttgccaccttgatgatgggatgctttaggtagccttagctatcctttttacttggttgtgtcctaagccaggggttcttaccctggctgttcattaatgtataaatgtacaatgtataaaatcccaaagccaggctccttgttggacaagaggaattttttaaatattttattttattttatttattttatatttttattttattttatattattttattttattttattttaattattttattttatttgagatggagtttggtcttgttgcccaggctggagtgcaatggcacaatctcatctaactgcaacctctgcctcccgggttcaagcgattctgctgcctcagcttcccgagtagctgggtttataggcacccgccaccatgcctggctaatttttgtttttgtttttgtttttgttttttttagtagagatggggtttcgccatgttggccaggatggtctggaactcctgacctcaggtgatctacctgcctcagcctcccaaagtgctgggattacaggtgtgagccaccatggctggcagagataaattttttttttaaagctccttgggctgttgcaaggtgtggtgctgtttaaagtaatcactatcttaagtaatgatatgcatgaaatctaatggtaaaatatatacataaaaagacatgcatatatatgaatacccaaaacatgttcatgtctatcaaagggaacaaagtttccattagacaggaggataagttttcctaatctattgtacagtatgatgagcatagttaataataatgtatatttcaaaattgctgcaagactagattttaaatgttcttaccacagaaaactggtaagtaggtgaggggatgagttagcttgatggaatcattctatgttgcatctatataccaaaagatcacattgtaccacacacatatgtacaattatttgtcaatcaaaaataaataaataaataaaatactctgtatgatactataatggtaaatacaagtaattatgcctttgtccaaacccacagaatgtacaataccaagagtgaaccctaatgtacaaaatgacctttgggtaatttggatgtgtcaatataggtcccttttacattgtaataaatgcagcatcctaaggggatgttgctcagggtgggggtgataggccattcaagtgtgtgggtgtaggggggcaggtgggaaatctctgtaccttcctcataatttttctgtgaacctatcgtaaagctcctctaaatacaaaaacaaaaacgtgctcatccacaaccaaccaaaagtcatcctggctttcgtgttttgagaaactctaaactagatgctaaaaggcctttcccatctttctggtccaaatctaggaaatgacaggattcttcttatcgagcccctcttatgtagtagaccccaccaggccgctttgcatgtgtgatggcatggcgcatagcagcagccctcagcagaggtcatgatcagccccatttcatagacctggaaactggggcttaggggctcccaaagctgagtcttctaaaactaagaagttagctgcagagaactcaaccccagctgcacgcctctgctttctatcatgtcaggagcagaaaagtgagtggccctgcctttcagggggcttagattgaggagctgggattccatttgtgttactggtttgtaatatcagctaagcagaggccttccaaaggactggcaccagggaccaggaatgctcagatgagcacgtcactctgcagacagtccagatttagcactgtcacccatgccatttcctccctttgatttcttccaacatgagacacaaaaggatagagtttcactcatataagagaggtccagctttaataatcagcactgtaatgatcagagttttcattattcaattgtttgcatggccaacaggctggcccatgacctttcattcccagcaaagcctaattgcatgaaagtgccacacagtttgaaaacaggctgcattatttacggatccaatcgaattagcttgcaattcccagaccagctttagatcaatgagatgcattgtgtgttctcccacgtgggtaaggaggcctctctgctcctgggcagcccaagacagctctgtagtcagaagatgagtctttgacggcttccaaagcatcgtcttaatgggcacagtaggatgctagaggggatcccccaaatctatttcatttttaaacaaaaaagagtgaatgtttctgcttatgaaattctggaaagttagtcctagccaggaaggggccggaggactccgttgcagaactcctgccttgtggaaatcaggaaaccgagactgagtgaagcagccagttagcggagctggagaaggatgtcccatgtcctgagactgaccccattcttgatcccaagcactgtaaatactgtgctgattaagatttagccactgtcccctgggaatgcactgggaatgagggtcaccaagaggtcacaggcataaaaagaaccttcctgcatattgttatctgtgctctgacagaggcaaaacagggcgctggaaaggaggcagcgtgtttgttttagcttcactcattcatgcgttcacttattcatccgatggtgtatattgagcacctaccttgtgtcaggcccaccctattctaggcattatggacccagagccaacaaggtgggaaaagtcccatctccagctcctcacaccaagtggggcatcagactaattaaccaacacacttaaattgacgttcaggtaccattatagcaaactctagaaagcagtgtaaggtgatgagagaggcaatatcaggaaattctgatgtgatgggaggagtgggaattaactgaacatctgtagatgtggggttgtgggttgggtgggggtccaggcagaaggagcagcaagggccagggctggaaagagcttgtgtgtgagggtttcagggactggtgtggtggggttgtcaaggcctgtcttgtgacgtggttagggatgtgggactgcagcctaagagccatgggaaatctagatggtttctatatttgggcaagggggttggaggatgatcaggggagctctttacaaagagctgctggctgctgggctgtcagggttggggagaatggggggatggtgacaaggtggaagcagagaccaaatttggcccacataaaagatgatgctcataccaagtcaagtctactaatagtaaactaatccaaggatcacaggagacaagccctgccaagtcctccatgcacacagtccctggccatggtcaacaggagacctgtgtagctactgtcattacccagcccgtgcagctctcacaccctgctggacaggtgacgtttatcctctttcaaaactctccaggaagtatcttgtgggaaggtagtgaaatttggcttcaatggcatagtgaggttgcagttctgatgacctaaccgtgaccatgggcaagttatgtaaccaagctgagtcaccaattctttgttcataaagaaaaatttgagtctctctttgcaggtcgagtgctgcaattaaaaagatgcatgtaaagccgggcactgccgagctgttcactaaaccttagtcctccccaaaaccccacctatgtgcagactcctccctcatccctttcacgtgctgaggagtctctgagggtctaactcagtttcctccttttgtccagggctccatgaaaatcaaatttctgctcttaatggcttattatcacttgctcgagtgtgttatgtgggattgtgttacaggaaagagctaaggttgtttgtcttgcaacagatgggataagtaagttagagcttcggtatgtcacccccactgtctatcagcccggctgcttcccaccttcctgtctccattggaggctcatctatctactcccaggcggcttccttctgactcagatggcttcccggcagccgaagcatgattctagaacaccctcttccccccggctctgcttctgtgaacacactcaaccctcaaaacttagcctcagtcttgccttttccaagaaatcttcagtatctacccagaaatcatctggatgaggaacagtgttttataaacactggactaagatatcccagcctggcttcctctgagcatctggcccgcttaaaatatgtatgtgggacaagcagctgtgtggctgaagccttggtccatgtctaaggggcagacttccgtgttagttaccccaatacgcccactctctgcttcagtgagcaagctctctgcactcgcctgcttacccactcactcagcaacacctgcagctgcctggccgacctgggtggggctggggacgctgaggtgggaaacgggtgtcgctgtgctcgtgggttgtcatcccggtggtggtgtccgaaatccagggcgagggccacccaaactgttcccttaaagaaccacatgggccctgtgtccttaagccccagggctaatgtcatcccaagcccttctgccctgcagagctttccgcccttttcaagggcttcccccgccagccccttttctcctactctgtccccggggatgtttttctcttactgactctctcccctcagcagcacccccagcacccaccaatcttccctgatctgagccagtcctgacatatacaccacagaacgtcccgtgctggatcggcttcctaaatccccttgggggaatcaaaagaagaaaagtaacaaatctggagaactattactatttcatgactcaaaagaaacaagaaaagtatggagtcaaactgaagcatacattcaatacacatttttccaggttttaatcatttcattcattaaaccccgtacatgagcgcacccacgcaaggagctgatggacacagaggcacgccgtccagccctcctgcgaccccgcacttgtcagccaggaatgtcctggcacacctgcagtttcgaggtcccctgggggagcagcatggaatcagtttctggcaaagccaaggccacagccgcagggtttgccttgggagatggtgagagggactgtagccagagctctcacttggcattttgtgtgccttcatccttacagctcttgtcttcatacgagggcagctggagcctgttgtgagcagtgcaggactcgcggccaggctccctgagttctgatcctgcctcttccccttgttcactgtggcgtgaggcaaatcccttccactcatggggcttctgtgtcctcatctgtaaacaggtgtgcagacaatgatgccagcctcacaggagtgttatgaggattgaaacagtaggtacacagctcctagaacagcacctggcactagaaatgtttgatcatcagtgggggaatcaaagctcagagaggtgaagctactagcccaaagtcacacagcaagaaagaagcaggatgacacgtgagccaagccccctctgccacactagctctggaggccattggctctcaggtgatgggttttctttgtacctggacatgggggtcaggaaagctccagtgtagctgctgacctttgacctgaaggaatctgggatctctcagatggggagtccaccatcagtctcagcaaaaacactaccaatcaaccagtccatcgctgatgtctgaaactctctggtgcaggacgtttcaccctttctggttttgtcgagttggccccctcctggtagagcactgccaccccgcaggtttccaagggccaagtcctggtagtactgacagttgaccagctaagctgcatcctaggcacccaggctgggctcgggctgctgtgtcaccaaaatccctggtctttgtaccattgggtacaaagaacacttctcaacagaagtggagcgaagtcctctttgcctcgacccttggcctggtgccaggccttctgttcactctcagatcagggatgctctggcctcctgggggactaagatgttcaggagctcatcctgggccacccacaggcatcccagctcctctcaatgctggttgcttggcactgagccataattgaacgattccagacttcaccttctgcatctcgaaggtggaataagggcaatgaaccccacctcatgggctggctgaagggatacctgcatggatcctgggtgtgatgcttaatttcaggtgcctgaattaaagaatccctagaaagctggtcaagcctcactttggggtgtgtctgtgacggcgtttctggaggagactggtgtgggagtctgtggactgaagggagcagatctgccctccagtggggggcaggcaccatccattgactggtggtctagatcaaacaaaatgggcagaaaaaaaggcatttcttttgtttgtttgttttgttttgttttgtttctctgtctgtctctctcctggagctgggatactcttcttctcctgctcttgaaggtcagaactccgagctccctgacctttggactttaggacttgcaccagcgtcccatccactgctctggttctcaggcctttggcgtcagactgagaattaccattggctttcctggtgctgaagcttctggatttggactgagccgtgctgccagaatcccagggtctccagcttgcagatggcctgtcaagggacttctcagcctccataatcatgtgagccaattccataataaatcccatccatccatccatccatccatctagctagttagctgtccacgtcctgtgtatataaacagattataacacgttttctgtctccctggagaaccctgagtaaactacacttgagaaggcccagttccacccctttgggcttcggttccatcacttgcaaattgtgtgaccccatacacatttccgtaaacctgagcctcagtttcctcatttgtgaaattgaccaaaaaaaaagaataactaagtcccagactttgggtcaagatgaaaagagatagtgtacgaaatgtctgatcacagtgctgaaagcgcatatcacagagtaaaattcaaccaatccataaggccatcgctcttccataacattgtggctgtgctgctattgggtgtttacgctacacacacaattccatgtggtggtttcaatattctctttaccctttgttgtcctgctttttccagtttccattccagtgtatttttcctcaacattagcatcattttacatggctgtttaacattctatcttttactcggccatatttcatttaaccagtcggtcatttgggttttctccctttttccaatactacacacagctctgtagtgagcacgtatgggtaaatcattcctccatcatccagattctatccttagcacagatttcaagaaatggaattattgtatcaaaaggcaatgcacagaaacaacaggcggtgcatgcttttaaatctcttgatgcgtattgatctttcatgttccaaaaaggattctagtccgggatttccaccctggtaagtatcaggaggctgtgtggcccaccgctcctccttgggcttgctaaggagcaagcggggcctctagacttaattgttaagcattctcaaatcctgctgcacaaccttgttcagaaatactgcctttgagtcattcactcatttatttagtcattcaatgcttaattcccaatcctcagcctactcagccatctttctttttaatagccttgttgaagtgtgatttatgtaccataaaatgcactcattttaagagtacaatttaacggtttttagtaccctcacagcagtatgcaaccatgatgacaatctaattttggagcattgtcatcatctcaaaatgagacctcagcccctggccaccactgaactgtgttctgcctctctagattacggacttgccttttcggaacatttcataaaaatgggatcatacggtacggtatatgaccttttgtatctggcttctctcacttagtgtcatgtttttgatgttcatcctgtcgcattagccttcttctgggcaaacctttttctcctggcctcctcgacacagtgctctttacattttctctacttcctcagttgctcctcccagagctgagactggggtgaagtgactgaggcagttgtctgggaatcaaaattaaagagaatactgaaaactcagtcatcaaggtaaataataattaatccaacagtttaaaaaataaaatgaatgaaaaaaacctaactttatcacaaacaaaatgtcaacattttaaataaaggcaggggctgggcacagtggctcacacctgtaatcccagcactatggaaggccaaggtgggcagatcacttgaggtcaggagttcaagaccagcctgagcgacatggtgaaaccctgtctccactaaaaacacacaaaaaattagccaggcgggtagcgcatgcctgtaatctcagctactcgggaggctgaggcacgagaatcgctagaacctgggaggtgaaggttgcagtgagctgagacggcaccactgcactccagcctgggtgacagaatgagactctgtctcaaaaataaataaataataaataaataaataaaggcaggacccacggtagctgtgataaggaggaggtgagtgaggtgagtctggcaggaagagagttggccttgagacaaggtgtccccatcacactgtctggaaaatggtcctgagcactctgggcctctttcttgctttgatttttctccctaagactttctgcatttgtgagtcccttacatagtatgtgtatatttgtgaagtgtgtgtgaggggtgatgcctttaaaaaaattagtccaggccaggtgcagtggctcacgcctgtaatcccagtgctttgagaggccgaggcgggcggatcacttgaggtcaaggagttcaagaccagcctggccaacatggtgaaacccagtctctactaaaaatgcaaaaattagtggatatggtggcaggcacctgtaatccaagctactagcgaggctgaggcaggagaatcacttaaacccaggagatggaagttgcagtgagccgagatagcaccactgcactccagcctgggtgacagagtaagactctgtctcaaaaaaaaaaaaaaaaaaaaaaaaaaattagttcagacaagtgggtacagccaggccacggaacaaagtgttcctctatcacttggattcttccattaaaatagatttcaatcaatggaactactgtgtcaaattcaaggcaaaagaactaaatgcaatggacattttaaagtcgcttgatggatcttgatgttttacaccaaggttttacgcaatgacatggagcatgtctgcttcacatcccgggagagcctcggacggcaagctaaggatcccgaacttgattcttaggcatggagggcttttaggcaaagagcaccaaggtccctcagtcactgtcaaacactcattcacacaaaacagagatggcagcacactagagcaggatcaacatttttcttaaagggctaggtggctaaatagtctcatctaagctagccatggaatttctgttgctctcacaactctgccgttctagtgtagaagcagccgtagacaatggttaaacagatgtgcatgattgtgttccagtaaagctttattttaaaaagcaaggagctggcccagttggcatgtgagtcaaagtttgctaccctgctctagagtgttcatgtgagctcaatgaatctccgacttcatgcttgttgcagaaatggacctggaatgtcccttaacagttttcagtagaactgccttactcagaacttttctctgacagtgtaagtgccgcacacacttaacagtgcccagtggagcaccctcatgcacatgcagtgtgagccttttggaagctggtggagggccagtgcatggaggagggaatgaatgaatgtccatctgtgctcaacagcagatagtgcaagatgggacgtgaagggccagaggaaactggaaggtatgcaaaagccatttccaacaaaacctgtagtttcccatgaagtgaacacttcttttcccccacctcctcgtcctccgctattctctatcttcatgaacaataacatcaaacacctccctcctgcttatgctaggtgacgcctaaataacttgcctcatcctcctcgctgccttccttctcctggatccccacattcagggggttctatctctgaagatggttctaacttggtcccctccatccccactgtcatcctcctggtccaagcccttgtcttctccagcaggctggacatcagcctgctgactggtctcaccatggcccatctccactctccagtccaattctctacagcatccctggagtcatctttctcaaaagcaggcagtgtcattgcttctctgctccaaacccttagatggcttttagttgctcagttctagattaagccttcacttaaagaaagaaagaagaaaggaagggaggagggaattgcaagcatctgcaatgagcgccagttccagggcagcactgtgccagtgacatctcctctgcacccacctgcccctggcacatgacctgcagagacaccaccggctcccagcatagagagctccactttgcccacacaccttgccctgctcccgtcgttgccttggcattcaacattcccccaaccaggagcacccttgcctgttttcttggcctgaccaattcctactcacattttagggttttcctccagttcgaatcttcctctgcatctccttcaggaagagttttcatgcccctctggagtccagaatgtttaattccagtgcctggtgccagccctagagccaac

SEQ ID NO: 1359 - DNA, 195267 bp, Homo sapiens
ttagattagtacaggtttacttttaaatatttaataatataaaagacttgcatagcttcaattcatttaagcttcccaataatgggtaaattttaagtttcctgaaaagtgagatcatccatgtagacaatcctgtttttgacataattgtccaacgtggaggaggaaacttgttaaggccttccatttatcttaccatcagtgacagctgagtcgattttctcttctggtgggtatgctttgttccttttggaaaatgcctggctgatttctgcataggttctgtttttggtctcaggcagcacaaaatacaggtagatagcacctgtgatacaaattgtagcaaagactaggaaacagtaggtgtccagacttttctgtggaaaggcagagacaaaaaccctcaaatagataatcagtaaacttgctgttaaaccatctctacacagatttttaagatagctccacattcatataccaatactcctagacaaaacaccatgtgtgatgctggctcaataaggcaagtgtaccctacatgaagtgttatcacataaggcttgaataaatcagcttcaaactctgggaaagatgagaaaatggcacttttttgttgttgttgttgcaaatttggcatttaaaaattaatcatcacgaaagcaaaatggaatgcttgctgaatattagcttaagcttatatttacaattaaccacattgtcttcttgcttctactatacacatgagacaagaatgacatcaaaagggaagagaaatgccttagttcataggaagaatgtggagcacagaataggccaaggtaatgccagttttttctaatatgcaaatgatctaactcactaattgatactctgaggcggccttgcacaaataagagagatcagaaaaaatagaaatgctcaatgcaatcactccgttttatgtatcctgattagtgtttggactagaataaccctgccaactgcactagaccttgagcttctcagtgactcagtcacctctgtagctcctgtgccttataggaggtactcaggacatatttgtggaataaaagacttgaaatcctagcctcaatcaatctgcttgctttggtctcccaggtactgggattataggcatgagccaccattccagaaataaaagactttctgggtcccagctgtcaggattgtgactattatatgcaacaaacatctactgatccaaagataaggtgacactgtctttgaataatatttcccaagaagcaatatccagattttagtcaattccattctattctttgatttgacaaacatttatttttggagaatggcaaagtgcttaagcttgatccctggatcacatcctagatctaccatttactaaatctgagactctttgtccctcagtttccatgattgaaaaagaggataatcatggtacatgtagggttgttgtatgaattaaatgagacattccctttaaagtgccacatgcagtaaatgttccacacctgggggtgcttagctcttgagactgtgccttctgctcgtacaaagacttcaagagtagtgtggagaagggggagagtatgggctctgaagccagtcgagtgggattcaaatcctgatcccattactcacatgttgttctaacacttatgatgtgccatttaagatagaatttcaatccactgagcatctgtttcctcatttgcaacatggtgatatatacccacacattgttttgaagatgaaatgagatatatcaattttgcattcaacatcctccacacccccatctgcaggcggaatggacatctgacttatcaagtccaaagtggagcctctaaaactgcctgctctagccttcctcatctctgctgatggcacctccatccttctgattgattatgccaacaaaaacacttggaggcaggctgagcttctctctctctctcccacccacatctgctccatcaggaaatcatgttgctccaccttgaaatgtattccaaatctgagggtttgtcatcacttctattgtaacctaattttggtgcaagccaccatcatgttttgcttggatttttgcaatagcttgtcaactgatttccctgcttttcactttaagcataatcttaagattattcttaacagacaagccagagtgatcctgttaaacaaaggacaaaacttgtcactcctctgctcaaaacccaccatgacttcctaagtcacctgcaggaaagccaaagtcctcaccatggcctccaaggccaccgaccatgtgtccctcttatttctctgatcttactctcctcactttctttgccccaactccactgcctttatgatttccctccagtattaggcctcagaatctttgcacatgctgttctctcttgctggaataatcttcgtttaggcctctgtatatcctgctttcttactcctcttcatccgacttaaaggtcattttctcagagaggttctcgttgactctcattttgaaatagcccctcccagccctgcttcattgccttcaaaaacactcatcactatgcagcattatagtgtgcaactgcctgtttattaaccttctccctaccaagaggtaactatctgaaggcaggagtcatcatttttcttgtattcccagagcccggagagtctctgatatacagtagatgctctgagtatcttagtgagtggatggatggactgaggctcagagaggcttcctgccgtatcccaggccacaaacagggcttcctaggacctctctgacacccacacagctgcctcttgcttggctttcttttcccaagggacctgatgggtgtcgtgaggattattctcacagtttcacaaaattcagtcaagaacatgtggctcagccgagcacagtagctcacacctgtaatcccagcactttgggaggctgaggtgggtggatcacttgaggtcagaagttcaggaccagcccggccaacattgtgaaaccccatctctactaaaattacaaaaattagctaggcgtggtggcagtcgcctgttatcccagctacttgagagactgaggtaaagattaaaactggaccccctccttacaccttatacaaaaattaactcaagatgcttaaagacttaaatgtaaaacccaaaactataaaaaccctagaagaaaatctaggcaataccattcgggacatagtcacgggcaaagatttcatgacaaaaatgtcaaaaaaaaaaaaaaagaagagcaacaaaagcaaaaattgacgaatgggatctaattaaactaaagagcttctccactgcaaaagaaactatcatcatagtgaacatacaacctacacaatgagagaaagtttttgcaatctatccatctgacagaggtctaatatccagagttcataaggaacttaaacaaatttacaagaaaaaacaacctcattaaaaagtgggcaaaggacacacacagatgcttctcaaaagaagacattcatatggccaaaaaacatatgaaaaaaagctcaacatcactgatcattagagaaaggcaaatcaaaaccacaatgagataccatctcataccagtcaaaatggcgattattaaaaagtcaagaaacaacagatgctggcgagcttgcggagaaaaaggaatgcttctacattgttggtgggagtttaaattagttcaatcattgtgaaaaacagcatggtgattcctcaaagacctagagacagaaatgccatttgtctcagcaatcccattactgggtatctacccaaaggaatgtaaatcattgtattataaagatacatgcatgtgtatatttattgcagcactattcacaacagcaaagatatggaatcaacccaaatgtgcatcaacgatagactggataaagaaaatgtggcacatatacaccatggaatactatgtagccataaaaaggaatgagatcaagtcctttgcagtgacatggatggagctggaagctgttaccctcagaaaactaacacaggaacagaaaaccaaacactgcatgttctcacttataagtgggagctgaacaacgagaacacatggacacattgaggggaacaatactggggcctatcagggggttgtggtggagggagagtgttaggaagaatagctaatggactctgggtttaatattaatacctaggtgattggttgatctgtgtagcaaaccaccacggcatgtgtttacttgtgtaacaaacctgcacatcctgcacatgtaccccaaacttagaataaaagttgaagaaaaacaaaaagctcagaaaaagtttgactagtcctgcccgtctcactctgcttaggcactcaggatatgacccaatattcttcaggttgaaaagaataatttgctcttttccagaatttattgagctcaaactgcattttataacttgagtagaatcaaagaggcatacatttgcatgcaattttctctgaatcggaaaatattggcactccacactggagagtgtttttcgcaggctttataacaaatggcccaagcaacactgatgctgaccacagcaaatgctgccaacaggatcccagagccagagtgtggaggtgagcatgaagggatgtgggctcctccccacaaccacagttgcctcccttctctgttggtgatgagaaggctaaggattttccctgttttacaggtgaggaaacccaggcttggagaggaaacccatgcttgaggagcatgctcagggccctccgctaatacatgggcttcaatacaggcgtgattcgtgccgttgtctgtggctctactggctcagacattttattctgaggaagaagcccaggcttcttaggggtctgtttgggggctggaatacatttgccactgatacttattggaataagtgaaacaatcaagttgtgtgagtagtttctcttggtggctgctgtgggctgaactgcgtccctcctgaaattcatacgttgagtcctaagccctagcacctcaggatgtgattaagttgaaatgaggtcattagggtggggccctaatccaatatcctgctattctcataagagaggagaagaggacacagatcaacacagaagggagaccatgcgaggacacagggagaagacagctgcaaggaacatggttgtgctttggtcaagggtaggctgaggtaaacatccagagtgactcagtgagtttagagggcaggtgtataactctacttgttatcacagccatgtagccataacatgggaagggcatcccttggccctacaccactgttgtctgtaaaaggtataactgccctgctgacactgtacatgcactcttgcgctgccgcccagagaaagagagagaaaaccagagctgtccatctgcaaaatggaaagaggggagccaggacatagcttgagttctggtgcccagagaaagagttaagctgctgaccttgaagggcaagctggcagtgcagccatgtgtgggagctgctggactaagcagccaagacagggtggacagtgtgagagaactagtgtgagtgagcttctcatgagagactacattgcacctgcctacggccccctgagtgttcttccagctgtctgctcatccacccactcccttcggacctcagcatgagctggaacctgaccctggggataacaattggtgtagttgtgaacttgacaacagccattaacaagccaaggagaggggcctcagaagaaatcaaccgtgctaagcccttgagctcagacttctaccttctagaattgtgagacaataaatttctgttgttgaagctccctagtctgtgctatttggtcatggcggcccgaggcccgagtagatgaacacagtagctcttgattgtggctgagctggttttcagaagggaggtaggtcagaaatggttcacgtatggcatctagaacacatacacgttgctcccatgggcgggcgtgagtggggctgtggtgggctggggttgggggatgtgactcagaacttgttagccctgtatttctctaatgcattgatcattgctcacagcagccccctgagcccagctctctaacttgctaagctcctctccggaaaggaaattaaccgtgggtgccttcccaggcttgggtcaggaggctgacatttcacaaaatactaaacgtatctacctgcccagtgtctccatctgtatgtccagcctggctgttcctgctccgatgaaggttcatcaatagtcacacctgcaatgtttcccgaatgacccctgaaaacccagacaccctggacatacccagcttctcaggaactgtttccagaggggatttgtttcgaaaatgcccacaggcataagaaaaggctcataaatgacaggcaagagaagcaagaacaaaacaaagaattgattccagtttttagaaatacaaaaaattatctaggtttggaagtgcagtgaccttggaagttactacatctctctgagctcatccccttgcctgtcaaagggagtgatacaggcactacctcctagcacaggcagcggtggagcactctgggcacacagcaagcattcagtgaacactatactaaagtggcatgttggtgctgttaatgctcaaactgtggcaggcaagcaaggtctttcacaccccacacccctgagtggctcagaagatagtggcctgcttctcggacatacaaatctcagtactgggccatgtgaaggtgctggaacttctctacttaatttataaatgtgatgggggaaccatgttgacagaagcagcttgaagttaacttttgccacaataatgaggattttactgacacctggctctgctggctttgagccaaactgtaaaaagccacttaaggtttaaagtcaattgaaaagatacttgttatgttctgactgcagccacgtgaaggtgtcccaggatgggaataaatgagtgtgggatcttgactaactccatggctcatggagcccccagcagcccttacgtttcagaaatagagtgtttgttgctaaaacacaaagatgtcttgaaagttacagggtgtggcagccttctaactctgagacgaggaggctgtagcaagtgatggatggagagggaagttgagcacaaggtggtgaagtggagaaactgggtttgatgctgactgtgggacctgggctgaccatgtctgcttcctggacctccttgcctgtacagtggcaaggatcagaaactccagctcaggactgtgtgagggtgatgtgggcacagaaagccatgcatgggggagggtgcggcacagagcaactgctccgtaactgtgaatgcaggaacagccaccatgctggggtggctggggcttggagtgccgcaaatactgacctttggctcacccaagctggcagcagaatctctgggatgtgttgggcttggcactagtaaattagcaggcggacttagaactgagtgtccagaatagttggtgaggggaggaagacaggaagacaggattgaaatagctcctgagaatgggtggtgatgtatatgacggattctcacctcctccaggtggtaccacccagcactgagggcagcagggagccctggtgggcatttgagcagggaagcttcatcctccttctgcaaatgcttctgggccccttgctctgtgcagaaggcttgcaaagccttttgtgttcctgctcccagataaccctcttatctgatcctctctctcacccatctttcttgctcactctgtttcagtcatataggcctctgggtggtttcttacacaggccaaatattagccctgcctaagggcccttgcacttgctgtttttctagccaggacttcaccattcccagacagctctgctccctcacttcactcaggcctctgcgcaacggtcacctccttccagagcccttcacgattgccccatttaaaatagcacttatgcctcttttgtttccccgttcagctccagaaccaggaaacacaggctttgttaccactgtatcctcattgcctagaaaagtgcctggcacacagctgggactcaacatatatatgtgttgaattaatgaattcggtttccaatgaacagatcctttccctacccaaaaagacttgtatctgattcttgagtatgtgggcattttcctactgatcactgtcacccttgggacaatgatcccattagctgtggttatgatgatgacaatgaggatgttaaatgggtggtggtttgcagtgtgcactggaactattagatggaatttgtcttacacagtgatgagcacattgtaaaaatgataagtaggttgtaggtttgagttgctaacctaggagtccttgcataccgtcagcaatgggtagcccacaccctctgaaagagcccacagcatttagggaagctctaggaaggcacaggaaagagaaagggatgaaaggttttgcccaaagcatagtttcttccttccttaggaaaatagcatgagtttccagttgagaggagagagatcaacttctgctctatgaatcacccctcaagtgctgcagaatcaaagggaaccccatgggcaaaagactccttgtcagtcatacctgaatgaatgggaagaggagcccaacagcaaagttggagagccagttgacggtgcctgcaatgatgaaggcagccggccgctgagattgctggaagaactcaccagtcaagatgaacgggatgccacctgcagtgtgtgagccaggacatggaattaatcactctgagaaggtcatgcctccagcatccatctccatctgccacactttagaacccccccacccctgccccttgactggatgtgtagtgggccccagttcctgagtcgccctggtggcattgcagtgggacaagtctttattttgagagactgtcctgtgcaattgcagggcatttattaccctttactttctgatgccaggagagcctccagtcaccaccacaacccaagccaaccctacacatttccaaactcacatgtggtctcaggtctatacccttcctttcctccatatcctgtacagtgagaccagtgatcacgccctgtgcccagaccaggacctagggctcagcatgactgctgggatcccacttgaacctccccatctccagctggagtcaccactctgccaatgagatctacacctgggtgtttctcagacaagacagagtgggtaatggatgggaaatccctcagggacttttactaaactctagagagacagtgaacacaatttggaaattactaggctggaggcattcattgtgtcaacatccaacaattatttatgtgctggggctgttccaacagtgaggtcaaaagcaacatgtccttgctttcatgcggaacccttgtctgctgggatgacttgttcattaaaatgggagtgagtccaggaatggaaaaccaaacatcgtatgttgtcactcaaaagtgagagctaagctacgaggatgcaaaggcataagaatgatacaactggggccaggcgcggtggctcacacctgtaatcccagcactttgggaggcagaggccagtggattacatgaggtcaggagtttgagaccagcctgactaacatggtgaaaccccatctctactaaaaatacaaaaattagctgggcgtggtggtgcatgcttgttatcccggctactcgagaggctgaggcaggagaatcatttgaacctggaaggtggaggttgcagtgagccgagatcaagcatattgcacaccagcctgggcaacaagagtgaaactccctctcaaaaaaaaaaaaaaaaaaaaaaagataaaagaatgatacaacagactttgggaactcgggggaaagggtgggaggggggtgagttataaaacactacaaattgggtgaatgtatactgcttgggtgatgggtgcatcaaaatctcggaaatcaccaccaaaaaacttattcatgtaaccaaacaccacctgttccccaaaaaacctatggaaataaaaaaataaaaataaaaaaggggagtgagcaaatgaataaatacatataaatacaaaatgtgataagcattctggaggagatgcactgtctattttggcagtgggtggagaaggatgctctggggaggagatggtggagatgtggattgaagacgggaaggtggctcctgaagatctggggaagatcatgccgagtggagggaggggccagcagaggtcctacaggtgaaaggattgggccaaagtctacaacaggggccaatctgtccagacacctgaaggaggcagagaggaatggggtgaggtagcaaatgtgagcagggccaatgaagcagcctcttgtagatcatggagaggggtttgcagttgaagaaaaccactttgggctgctatgcagcagttgaggtgatcaatttgcatttcacagaggtcactgctctttggagaaaagcctggagggtgtaggagaggatgcagcaggctgttggggcagtccagggaggaggcaatggttgtttaggggggctcagatcacggcaggtgagatgaaaggaagggtctgaatttggagacaattgctccattgaggtaaagctttcaaggtaagcattgcacatacacaatcacttagcaagccgacccaaccaagcagcccagggtgacaaagccacaaagccaaggccaactcaagtctgaatctctccagacctttcaccgttatcaccccactatgatgccagcaaggcttgcactccaacaaatcaaaaacaactcggaatggagcgtcccctcacctcccactacactgtgagcccctctgatcaggcactatctccatttgtctggcatttcccacagagtagatactccatcaatatttacttacataagttaaatgctcaaaagttgattttgacaagatttgatatgctgttcactacaaaaatattagactctatatcttaaaggtatctattgaactgtgtgagaataatggttacacactgaaatgtaatgaaaccagcctttggttctgcaaaatatttcattgtcagaaagtgtttgtgtcacacactcagttggtcctgcagctaacaccactgggaatcagttcacagcaattctgaagcctgaacagggttaggtgatgatgtttcactttctgtgtctttcctaggtgtgtttttggaagcacctgtggataactcagtacttctgaggctggtacaatggaatgcggtacatcaatgtacaatgcagtagaacactgacaaattgcctcctggtacatctctttgtttcttcagggcttgaggccatgacttgtttattggttaagactcctgatcctagcacagtgctgaacacataccaggtgctctgtaagtgtttgcaggattgatgaaagaacaaataattaggatgccagggaattcatggtacattgatatcagatcctctctttcactaggccttcagaccaagccctaagcaaccatgaggagcctgcacagctccactgtacacaggtgtgttcactcccattatctcccttgatcttcccaaccagagaaggtggtaaagcatagtggactggagcttgggctttggtgttagtaagatcaggtttaagtcctatctcagctaaatctttctagaacggaattctctcacctgtaaagtgagtaggagcttgctactggggatatttgtgagcatgaaatgaactactaaatgcaaacacttaatataagtcttgtacatgaagggcactcaataggtgttagatactataataataataatcaagactcctctccattatatcccccattttatgatgagttagctgaagctaagagaaggggagtaatatatgcaaggtttcttagcaagaagtgatggtgatgaagaagatgatgatggtaatgatgatgacgatggtgcttctgtagctgctggtgaagatgatgatggtaactgtggcaggcattatgaaaagcattttacaaggtctctacaaggagaactacaaaccactgcttaaagaaatcatagatggcacaaacaaatggaaaaacattccatgctcattgataaaaagaactaatattgttaaaattgcccacagcaatttatgaattcaatgttattcccattaaactaccattgacattcttcacagagccataaaaaaccgttttaaaattcatgtggaaccaaaaaagagactgaatagccaaggcaatgctaagcaaaaagaacaaagctgggggcatcatactacctgacttaaaacaatactacagaattatagtaaccaaaacagcatggtactggtacaagaacacatatatagaccaatggaacaaaatagagaacccagaaataagactgtgcacctacaactatctgatctttgacacacctgacaaaaacaagcaatggggaaaggactgtattcaataaatgttgttgggataaatggctagccatttgcagaagattgaaactggactcctcccttacaccatatacaaaaatacactcaagatggattaaatacttaaatgtaaaacccaaaactatagaaaccctggaagacaacctaggcaataccattcggcaaataggcacaggcaaagatttcatgacgagaacaccaaaagcaattgcaacaaaagcaaaaattgacaaatgggatccaattaaactaaagagcttttgcacaacaaaagaaactatcaacagagtaaacagacaacctatagaatgggagaaatttttgcaaactatgcatctgacaaagatccagcatctatatgaaacttaaacaaatttacaagaataaaacccattaaaaagcaggcaaaggacatgaacacttttcaaaagaagacatacatgtggttaaaaatcatatgaagaaaagctcaatatcactgatcattagagaaatgtaaatcaaaaccacaatgagataccatctcacaacagtcataatgcctattactaaaaactaaaaaaataacagatactggctgggttgtggagaaaaaggaacatttatacactgttcgtgggagtgtaaattagttcaaccattatggaagacagtgtggccgttcctcaaagacctaaagacagaactactattcgacccagcaatctcattaccaggtatatacccaaaggaatacaaatacaaagatacatgcatgtgtatgttcattgcagcattattcacaataggaaagacatggaatcatcctagatgcccatcaatgatagactggataaagaaaatgtggtatatatacactatggaatactatgcagccataaaaaaagaatgagatcatgtcctttgcagggacatggatggaactggaggccattatcctagcaaactaaatgcaggaacagaaaaccaaatattacattttctcacttataaatgggagctaaatgatgagaacaaatggacacatagagcggaacaacacacactggggcttactggagggtgggaaaacagagaggatcaggaaaaatattaataacaaataggtactaggcttggtacctgggtgatgaaataatctgcataacaaacccttatgaaacacatttacctatgtaacaaacctgcacatgtaccccgaacttaaaaataaaagtttaaaaaagcactttacatatattatcttatttaattatcactatgatatgatagttactgctattatttttccatttactatacaaagaaacttaggcttgtggaaggtaagtaattttttcaagagcacatcaccagtaagctgcaaactcagtgactctgggtaactccacagcatgagttttaactactcccttgggccccaagcaagtctaagatactaacaaaacttaaaatacttgaaaagaacttagctatcttcatagttttatctgaatgctctcccaaaccctgcaattcatttatctctcttactgaaggccttggtggcctgatttcctaagagtcttttaaggtctctttcttccaatccaaggtaaaatgagaaagaatggggtttgataaagaaacagaatgcatttcaggcaggccttcttttatttttattttgtttttaagaatgaaaatagttttattgtttttttctgactttcatgaataatatttgctcatgtaaaataattttttaaagcatgcaacatgacaaagtataaaaaggaaacaaaaattacctctaagccttccacctagagatgatctccatttgtattttggtatttagctttgatgttaaatgttctgtgaagaagattggggctacttgggatatttgtcttttaggtgtttgcctttttctacctagaaccctgaggaaattgttctttatctttgaaattcattaactatgatgtttttggttgtattagtccatttttgcactgctataaagatatacctgacactgagtaatttataaagaataaagatttaattgactcagagttccaaatggctgcggaggcctcaggaaacttacaatcgtggaggaaggcaaaggggaagcaagacacgtcttaccatatcaaaagaggacaaagagagaaagcaggggaaacttccactttgaaaccattagatcttgtgagaactccctctctatcacaagaacagcatgggggaactactcccatgattcaatcacctcctacaagtccctcccctgacatgtggggattacaattcgagatgagatttgggtagggacacagaaccaaatcatattctggtgttgattttcctatagcaactttttgtagaacatagcatatccctttgagctgcagatccactcttcatttacttcttatgttatacctttgaaaatgtcttattttctacatgttggattctttgctttagagacacccattatccttgtgttggatcagctttgtttccctttcctattggccatctcgtgagcgactttgttctcttgttttctgcatagatattgtatgctctgggaaatctctctcttccttcttctctccctttctttcctttcttctttgttctagtttcccaggttggctctttccctgtgcattgtcctccatttctcttatccttattgcagtgagctactttgtccagattgccacctgctgtgatatgatggaagaccgatctttgacaccttttctttttatcttctagtttatcttggctttcacatcacagtttgagatctgagtactaactttcagtaagttttcaataaattatgggaaaatgtggcaggggtggggtgggtagaaaaattggttaggggtgtcagcagccctttatggaggatctgggttcttctctctctcttcttagattttgtaaagtgacatgcaccggaacccattccatgttgtcaggggcatattctactccagtggcctttaactggtttcctcaaattaggacatagtcttaggaagtggcaatccccaggaccctttgagagggctgtttggggggaaggtatcttcttgatctttctctgcaattgctgactcacctgctcactctgtctcccccataaaatcaaggtggtagcaagagttcttagggttcataaaatctccttctctggtcagtgctgttttctaaagagtggagacagaatctcctatgctagaattatcctttattggctgctagttttctaggtatgtgatatatttccttgtttggttactgctggccattttttttcaatctgtgtaaaggtttgctttgttggtattgttattgattttaacgactcttttcctgctcattttcttaggtatttgcaggaggaaggttctgtaacaagtctatacatgaccatatttacctaaaatcccttgattattagcttttcaaaggtaagttattggtatttcttgtggtaggtgtgtaggtgctgctcatctgaaaatcatatgcttcaaaattaaagagcaggtgaaaacaatcccttcttacaaaggattttgccaagagagtgccttctttaaaattctgtggtttgcgacctttacttttgtggacttttttattcataaaaatacttggcacaccttatctcatcaaatctttcttcatgaccaaactatgaattatgaattgtaattacagattcggaaactgaaatttcagggaatagagggccttgcccagttactagtcctgcttgtgactggaagagataggacatgaagttgggtcttctgaccatgtccttttgatggcacctctcatttcaaaagaacagaaagatggggaaggtgtcatgtctgtatccaatgtgtcttgcacagggtactcttcatatcacagtactcaatatatgttgcccaacagtccaatatagcttaaactttgaaaattagccccaaataattatgtatgtgggtccactcatcttgttatcttattagagtcttctttgctatcttgtttgagtatcctattctggattgccccagaagcagaccctgagaagcagtttatgtgccagttgatcccaggaaatgcagggaagagtgcagggaggtgaaagaggtggataagggctatgttattagcaacaccaccatgggaagtcacatcttaatccaactgggaccctcgggaaactgtggaaaacacatctcagagttacccagtctgaggggtaggagggctggattatttatccaccatgtctcatcagtcactcattgagtgttatactttgagcagtgcttttggcctgccacaatgtgggctgagagagctggggaagtcctcaagcaaaaagccacatacgggagcagttgtaggtctgtctgagaatcacaaaggggtgtggacaaagggatttggggaagataacaagaatctttgctatgccatctattccttaagtgtttaacttctcattgactattgcaataatcaggtagccattactaataacaacagtgaagaaaatgtttatatcatatacacctaagtactagtttcaggagttggggtataacactagcattaagaacatggggtggaggtcccacactctaattaggagcatggagtgggggtcttatgctaaagttaggggcctggggtgagggtgtaacactatagttaggggcctgggtgggggtctgatactatagtttggagcatgctgcttgaatcagaccatctgggttagagtcttggctctgccacttgcaggctctatgtgaccttgggcacattagttcacctttctggctcgactttcctcctctgtaaagcaaggacaatggaattgattttatggggtcattgcaaagcttaaaggacctaatgcagagaatacacattgaattgtgtctgaggtgtgatgaacactcaatagcttttaatgatgattattattattcagaagaagcatgttccaggagaatattcatcctgtgatctgagtaagcttcctggctcctggatcccatggacactgagccacacttgttgactaactgtttttcctgagtgggtggtttgcccaccaatttgctttggcagaaaaggccttccccaataacatatagtggctcttgccttagtagcacatgcactgtggaaaaggaaaccagatttgaatccatgcatttgaggcatagaatcctatgatactgcctaggactctaggtaaaataaaaactcttattttacagattaggaaaatgaagctcagagagggaaatgtatttgctcaaggtaatgaaacttggtggaagagccagatttagtaaaaaaaaaataataataaaaaaaaaaaaaagtccttctgactcctttctttacagaataacaagaggtgatatggattgaggtatatgtccctcaccttgaatttattttattcccctctttctttctctccatctctccttcccccactcatttttctcccttcttgccaggaaaatagaaaatacgtgctgattaattgagtattctatgtaaagaattgccaagtaatttaaaaaattctgtagatatcctaaaaatattcctaataattttgagacattatctacttcattagtaatgccattatttttccttcagaaatgttcataagcaaagaaatattcttccccctcattggtaaattcctaatagttatacttagttatgttcaagtgaaaaggaattgaattatgcacgttcttcatatgagacttactttttgaaaactgacttttcctccagatctctgttctctgtgaatctgtgctacagctcagctggtctaacaaccaagctgtcttgtggcgacagcgccctggtgtctacagtgaggaacaatctgctacctttctttctccagagataaacctgatataaattcccatcactttacctactagctatgtgaccacatgtatctatggttctcagttttctcatctataaaatgaagataacaatagttcctacttagttttgttttatgcattaaatgagactgtgcttagcaatgcacacctgtggtatttctgtaaagccagctttgttatttctgcttccagcaatgtttcctacatattatctttaggccctttctccctcctctctattttctaactcttgcccacgtaccctagaaaaagttcaatttttttttttgagacagagtctcgctctgttgtccaggctggagtgcagtggcgcaatctcggctcactgcaagctccacctcctgggttcatgccattctcctgcctcagcctcctgagtagctgggactacaggtgcccgccaccacacatggataattttttgtatttttagtagagatggggtttcaccgtgttagccaggatggtcttgatctcctgacctcgtgatccgcctgcctcggccccccaaagtgctgagattacaggcgtgagccaccacgcccagccaaaagttcaattttaattttatttttgaataaaagaaataaaggacaactgcccaagcttttccttaattcatatttattaaaattattccaatggaaccacgatcatcaatttcttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgaccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccctgatcatcaatttctaaagcccttcaaaatgcctataaacccccttagaaatttccttaagtgtatccatatgtcacttaatcctttaaataaattttccgttaagcaccatgtttaaaaatagctcttttcttttattgaaatacagtcattttgaaaactcttcacgggcattctgttttgtttatgtaaatagacttaatcttgttcatccattcgttcatccatttccatccgacatttacatgtcaagtcctgtgctaggcaattgcagactctactagttgatgtaagaactatcttgggaggcagttattctaactccatttaacggtgaagaagttgcgacccagagtagagagtgacttgctcaaggtggcacgagcagtaaatgatagacttggctccgaatccaagagatccggacccaggtaagagactctctcctctgccctttctctaggagagacatttgagaatttgaaaatgcacaggctcccaaacagatgtgttccatgacaacagccaagatatatcagcaaatagaactcatgccctgcagcatgttggaaagggtgggactggagtgcacacaggaagctcctcccctcacaggatgtatgccaggtctgtcctctcatttctgagaggagcttagacacccacctgctcaggcatgtgcttcctaggtagggaggcaggggaggctgctgagcaactagggatgaggaggtatagcagatgcttcctggggtctccttgcagagccttgactcaccctgactctcagtgggctcctctggctctgctgaccaccaggtgagaggctttggtccttctctagacctcagtttccttgcctataatctcatttaatgagctatttaaaatctcagtaaagtcgaaaccttgatagtgcttacttggcacatggcaaattattaccatgtggaggtagccaggctagtagctaagaccattggcactaactcttgcccaagtaaccagagaaagctcaattgtaatttcatttttacataaaagaaataaagtgcacacccaaacttttccttaattcatatttattaaaattattccagtggaaccactatcatcaatttctaaagcccccccaaatgcctagaaatctccttaaaaatctccacaagtgtgtccatatgtcacttaatcctttagatatattttctcttagtcaccaggtttaacccagtttaaattcccacctctccacttccaagctgtgtaaccacaggtaagtcgtatctctggctctccattttcttgtacataaaatgaggacagaacaggagttcctgcctcttaggtctgtactggggattaaatgagataatgcttagcaacatgtttaatgtgtggctgtattagtccgttttcacactgctgtgaagaactacctgagactgggtaatttatgaagaaaagaggcttaattgacttacagttctgcacggctggagaagcctgaggaaacttatgatcatggtggaaagggaaggggaagcaagtatatcttactgtggtggagcaggggagagaaagtgaaggcggagatgtcatacacttttaaaccatcagatctcatgagaactcactcactatcatgagaacagcataaaagaaaccacctccgtgatccaatcacctccaaccaggtccctcccctgacacatgggaattacaatttgacatgagatttgggtgggcacacagagccaaaccatattggcaaaggcccaatcaatatcaatgattacggcgattcctcttctgcctgtcattaatcccctcagtgtttgctgggaacggactacgtgccaggaacccatgctggggcatcaatggtggcagaaagctgattcaacttctgccttcaaggagccgtcagcatctgaggtccactgagtcaagaaaaccagccctgagcacaagattaacgttctccttcattgggcagtaataataaaaatagttaaaatttattgagcactttctatgtgttcttgaaaggttttccctttgtagggtttctaattattttagaaaaggagtgataaaatgtcatcagatatggcatcagacattgttgatcttgggcaaggaagatcaaattatcaggagtcactggtctgaactgaaagagcaaaggaattttcctcctgttgtatccagagacactgcaaaagttagaggcagaaaatatcttagggaccccctaggccagccccaacccaatatttcaggtggggaaactgaggctagagaggtggagtgagactcccagtgtttcagaggagtaggatccaggacttccaaactagcctgattgactgctctactgtgtcctccctaggaattcctggtgcccacccatgcttagactgttcccactgctggaaatgcccccgagctttggaaagatttcaaggcacacaaggatatgggtaatttacttcacatgagcttggctcccagtataggataaagaagcaatggcgcctttttccccttctacacagcccaaccaggtagccagcataagtaactacacaagcctgtggtctcaccacatgggatgtgttttctaaaaaaaaaaaaaaaaaatggaaaggagacttctccaggaatgggcatgagacatgagcatgtattaattaggcaaaaggggcaggtccctccaccactaccttattctcgatcacagcctcatgtttatttatttccatggattgcatcatcatctttgcatttatcttttgcttgttcattgtgctcctcgagggcaggcatcttgtctctttttctccctgttgcttgccccatagccaatcatgtctgtctcttgggtgcttgacagatgtttgctgaatgtgcagatgaagggaaaatgatgacagttaaacagatcttttaaggatgagtggaaattctttttttttttttttttggagaccgagtctcactctgtcacccaggctggagtggagtgcagtggcacgatctcggctcactgcaagctccacctcccagtttcacgccattctcctgcctcagcctcccgagtagctgggactacaggcacccgctaccacgcccggctaattttgtatttttagtaaagccggggtttctgcatgttggtcaggctggtctcaatctcctgaccttgtgatccgcctgcctcggcctcccgaagtgctgggattacaggcgtgagccaccgtgcctggccagaaattctttatgcagttgaggagatggagggctaaccagggtgcacgttcagtgagagcctgggctgcgatggggaggtgggacaggagaggcatcttgtgaggggccagcaggggtggattctagggtgtctaggaggccatgcttggggcaggagtttgcaggcagaagctgtaggcctgttggagggttttaggaggagaaagacaggatcagatttgtgatttgaaaagtgtccccgatgcagagtgggatatgggtcagcagaaggagggtgtggaggcagactgggacactggttaggaaacagtagttcagaactccagaaacaaaagggaagttgtttgtgaaaagaagttcgtgcctctcagcattgttaacaaccatacatggtgattctaacttgaatttgtgtaggatcagtcatgagacttagattgtttcctgaactctgctctagggaaatgtaaagtggttcttcctcttgactatcaattagcatgttttgacatagactttcttccagtgggatttaaaatctgtgttctttagttgaatcaataggcttgaacattaccatcctggactgtctgggggagaggatgtttttgaagagtctcaggagcaaatgggccatgaaaggccaaattgactgttaattctaattaaaaagaggaagctgctacagcataatgagtgtggacagttaattagcaggtaagaaaacacaattaaagtctctcagaacaaacctacagtgatgtgttctgtttggtggtgagttaagcacactcagatgacctgtttctaagcttggtgaggagtttctgtttcaatagagacggaggtcagcagtcttgctggtaggttctcatgggcgcattttaacattcttcctttttggatgagcatggtgctgggagggggtgttgaaatagaaaagcaagagtgactagataaaagatggtcgagctaggaggaacatctcccaccgagagaccgggacatcaggaagactggcacactcaagccacatcttcagagagaaggcattgagagtggatagagggaggatacagatgctgggctgaagcagggaagtctgggaaccctgcacggggctgctgagcaatgggacttgtttcctggcccccagcgactcctggggaagggatgagttgaacaggtgaggaatggcccgctctcaccatggacctccagaatcctagcagcaggataccccacaacccccacagacacttgagacgacagggagaactgcttagacaggtggcaggggcaggactccagcctgtgtgttgcccagagggtttggtgtgggaacatctgcagtgaagcatggccagtgatgcccattccccaaggcttgccatgctcctctaggagtgtgactgtcagacctggacagagcagggtggccttgcctgtgggatgaggccggtacattctgaatgccccccatctgctggactctcttggggccccagcctggttgtgcccagagggcagtatcagatgcccaaccagggtgcttccctgggaccctcttcatggcttctttgccagcagaccatgtcagaccatcgaagaactctagcagactggctcccactggtgtgcaccagctcacccacagcctcccctcaccgcagcctcccttcactggtgcacactcattcgtgccccactcccccaccatcccacatcgctttgctggtgcactgtgagtggaccttgcctccctctcttccagcacatgtgtgtgcattcatcacataatgccaccactgctggcatgtgcgtaccctgctgtgccccctactgatacatgggtaccctaccatgctgccactgccagcatgaatgcacaaatggacactggcaaccctgcccctgccagtgccccacccccactggtgcaagggctagcacaggtgctggcaaccccacccccaccagtgtcccacccctgctgtgctgctgccattcatcactggtgcagctatatgcaggaacaccaccacccaactcctgctggtgccccaccccaggcaatgcacgtgcaccccactgcactgttgcagctgctggcacacttgagcgagcatggatcccactgccgaagtgctttggctggcacacccatcgaagtgttgtggtcattgggctgggaacacctcggcccattcagcgtagcaggttcctaaccttgaggggccagagaacaaatctaggggcccaatgtcagtcccccagagccagagcatgaaacccaggagtgctgagctgagcgttggctccctaaaatcttcctgaaatgaagacagtcaactgaacccacctcatgctgcaatcaaaccctcaagggcatcaaagaagataaaagcaaaaaaccctatctaaaggtcagtagcctcaaagattgtaggatcatcagtcaacacagatgagaaagaaccagtgcaagaactctggcaactcaaaaagccagagtatctttttatctccaaatgaccacactaattccccagcaatggttcttaaccatagtgaaatgactgaaatgacagacatagaattcagaatatggataggaatgaagatcactgagatttgggagagtcaaaacccccaaggaatctaaggaattcaataaaacaatacaggaggtgaaagacgaaatggccattttaagaaaaaaccaaacttatctgatagagctgaaaaactcacttcaagaatgcataatataatcacaagtactagcagcagaatagcctaggatgaagaaaaaatctcagagcttgaagactggttctcagaaataattcagtcaacaaaaataaagaaaaaagaataaaaagaatgaacaaaatctctgagcaatatgagattatgtaaagagagcaaatctatgactcactggtgtctctgaaagcaagggagagaaagcaagcaacttggaaaacatatttgaggatattgtccatgaaaatttccttcaggaaatgcagggaacccctgtgagatactatataagatgaacatccccaagatacatagtccgtcagattctccaaggtcaaaatgaaagaaaaaatgttaaaggcagctagagagaagaggcaggacaccaacaaagtgaaccccgtcaggctaacagtggatgtttcagcagaaaccctataagccagaagatactgggggcctatatccagtattcttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcatgagccaccgcgcccggcctccagtattcttaaagaaaagaaattccaatcaagaattttgtagccagtcaaactaagcttcataaacaaaggagaaataagatgcttttcagataagcaagtgctaagggaattcattaccaccagatctgccatataaaagttcctgaagggagtgctaaatttggaaaggaaagaccattactggccactacaaaaacacacttaagtacacagaccagtgacactataaaacaactacacaatcaagtctgcataataaccagttaacaatatgatgacagaatcaaatctgcacataccagtattaaccttgaatgtaaatgggcaaaatgccccaattaaaaggcacagaggccaggtgtggtggctcatgcttgtaatcccagcactttgggaggccaaggtgtgcggatcacttaaggtcagcctggctaacatggtgataccccatttctactaaaatacaaaaattagctggatgtggtggtgtgcacctgtaatcccagctactcaggaggctgaggcaggagaatcacttgaacctgggaggcagagattgcagtgagccgagattgtgccactgcactccagcctgggcaacagagtgaaactccctctcaaaaaaaaaaaaaaaaaaggcacagagtgacaagcttgataaagaagccagacccaactatatgctgtcttcaagacacccatctcacattcagtgacacccgtagactcaaagtaaaaggatagagaaaaatttaccaagcgaatggaaaacagaaaaaaatcagggggttgctattctaatttcagacaaaacagattttaaaccaacaaaaataaataacacaaagaagtgcattacataatgataaatgactcaattcaacaagaatgcctaactatgctagatatatatgtacccaacatggagtacccagattcataaaacaagttcttagagacctacaaggagacataggtaaccacacaataatagcaggagatgtcaacaccccactgacagtatcagacagatgatcagggcagaaaaccagcaaagatatttgggacctgaacttaacactgaccaaatgaacctgacagacatctactgaattctctacccaaaaacaacagaatagacattcttctcatttgcacatactccaaaattgaccacacaattggccataaaacaatattcagcaaattgacaaaaaaataaaattataccaaccacacccttggaacacagtgcaataaaaatagaaatctttactaagaagatcactgaaaaccatacaattacatgaaaattaaacaacatgctcctgaatgacttttgggtgaatgatgaaattaaggcaaaaataaagaaattgattgaaattaatgagaacaaatatataacataccagaatctctgggacacagctaaaacagtgttaaaaaaaaaagttcacagtgctaaatgcccacatcaaaaagttagaaagatctcaaattaacaacctaacatcacacctagaggaattagcaaaccaatcccaaagctagcagaagataagaaataaccaaaatcagagctgaactgaaagaaattgagacacacacacaaaaaatacaaaatatcaatgaattcaagagttgatttttttaaagaataaataagactgataggccactatctaaactaattaaaaaagagagaaaattcaaatacacaatcagaagtgacaaagagacattatcactgaccccacagaaatacaaaaagccctcagagactattatgaacactgagaagaaactgataaattcctggaaatatacaacctcccaagattgaacaaggaagaaactggaaccctgaacagaccaataacaagttctgaaactgaattggcagttaaaagcctaccaaccaggaaaagctcaggaacagatggattcacaactgaattctaccagatgcataaagaagagctggtactattcctaccaaaactattccaaaaaattgagaaggatggaatccccttcaactcatcctatgaggccagcatgatcctgataccaaaacctggcagagacacatacatacacaaaataaaacttcaggccaatatccttgatgaatatagatgcaaaaatcctcaacaaaatcctagcaaaccaaatccagcagcacatccaatagcttatccactatgaggaagtaggctttatccctgggatgtaagattcctttgacatatacaaatcaatagatgtgactcatcacataaacaaaagtaaaaacagaaattacatgatcatgtcaatagatgcagaaacggctctgataaaactaatatcccttcatgttaaaaaccctccacaacttggcattgaaggaacataccccaaaataataacagccatctatgacagacccagagccaacatcatactgagtgggcaaaagctggaaacatcccccttgagaactagaaccagataaggctgcccactcttaccactcctattcaacatagtactggaagtcccaactggaacaatcaggcaagagaaagaaataaaagatgtccaaataggaagagaaaaagtcaaactatctctgtttgcagacaatataattttatacttagaaaaccccatagtctctgccaaaaagcttcgtgatctgataaacaactttaacaaagtttcaagatacaaaattaatgcactaaaaccagtagcatttctgtacaccaacaacatccaagctgagcacaagatcaagaattcagtcccattaacaataaccacacaagcatacaaaataaaattcctaggaatagagctaaccagggaggcgaaagatccctacaatgaaaattacaaaacactgctgaaagaaatcagagatgacacaaacaaatagaaaaacattccatgcttatgataggaaaaatcagtattgttaaaatggtcatagtgcccaaagcaatttacagattcaatgcaattcatgtcaaactatcaatgacatccttcacagaattagaaaaaactattataaaattaatataaaacccaaaaagagcccacatagcccagatcctaagcaaaaagaacaaagcaggagacaacatggtacctgacttcaaactatactacaaggctacagtaaccaaaacagcatggtagtggtacaaaaacagacacatataccaatggaacagaaaagagagtccagaaaaaaggccacctacctacaaccatctgatcttcaacaagctgacaaaaacaagcaatggggaaaggacttcctgtgcaataaatggtgctgggataattggggaactatatgcagaagactgaaactggacctcttccttacacaacgtacaaaaatcaactcaatatggatcaaagacttaaatgtaaaaacctaaatctataaaaaccctggatgaaaacttaggaaatatccattctggacataggccctggcacagattttatgacaaagacgccaaaagccattgcaacaaaaacaaaaattgactaatggaacctaattaaactaaagagcttctgcacagcaaaagaaactataaacagagtaaacatacaacccagagtatgggagaaaatatttgcaaactatgcatctgacaaaggtctaatatccagaacctgtaaggaacttaagcaaatcaacaagcaaaaagcaaataaccccatttaaaaatgggcaaaggacatgaacagacactttttaaaagaagacatacacgcaaccaacaataataataaaaaatgctcaatatcggtaatcattagagaaatgcaaatcaaaaccacaatgagatatcatctcacatcagtcagaatggctattcttaaaaagtaaaaaaataacagatgctggcaaggttgcagagaaaagagaaagcttatatactgttggtgggaatgtgttagttcagccactgtggaagcagtttggcaatttctcgaagaacttaaaacagaaataccatgtgatccagcagtcccattattgggtacacactcaaaggaatataaattgttctaccataaagacagatgcatgtgtatgttcattgcagcaactattcacaatagcaaagacatagagtcaacataaatgcccattaacagtagactggataaagaaaatgtggtacatatacaccatggaatactatgcagccataaaaaagaaaaagatcacgtcttttgcagcaacatggatggagctggaggccattatcctaagtcaactaatatagaaacagaaaaccaaataccacatgttctcaattataagtgggagctaaacattgagcacacatggacacaagggaacaatgacactgtggcctacttgagggtgagggatgggaggagggtgaggactgaaaaaacaggtactatactatgcttattacctgggtgatgaaataatctgtatatcaaactcctgtaacatgcaatttacctatatatcaaacctgcacatgtacccctgaaacgaaaagttaaaaaaagaaaaaagcgttctctgtatgggtgctggagttataaggctgcctgaaatagggtaaaaggatccaggggacatagctcagaacctgggttcccactcattcctgtgatttgaggccatcgcaccctcagtctaggtcttggttttcccagctgcagagcatttgtttgttcattcagtgaacaaaaagtactgagttcctgcttggagggggcgcagggttggatactgaagatagagcccggaaggagccacagtccctgggccagacagtgtctcaaatcctgtgcagttctgttgttctccggctcagaccctggaatgctggggcagatgtggatgactggttctttactccatcttccctcaccatctcaggctgtcccacatccacctgccggctggcatccctggcagaggcttttgttggcttttcacaagccagaagggctgtggaactgacagagcttctctccagggtggactgaagagagctgatgccctaatgcttcctgtgagatgatgcagttgtcttcccccacagtctcccagagttccccagagaatcacactgcaggtgcccacagcaggaacttgccctgaaatgcactccatggctgcctgcctggccctgcctgactcagtgcccactccctcctgatgtctcctgggatcaccccccaaacagactgccttcactggaatctgtgtcttagggtctcttggagaaacacttcccagcttttcaaagtcctgctatcccctccactgaagcctactctggcatgccctttactgaactcctattggtttctaatctacactgccacggtacctaggggaacaaacttattgtcccagctttaaaaataggatgtcccatgtctcagaaaccccttcagagtcagcaaatcagagcagttggtcactctaatagtatcacaatttaattatttcttgattacctaaaagggtttattgtattatgatatggggagaaagaacatactgagttgtaaatggttctgagacactaaattgatctgcatagggaagcactgagtagaaagaggggaggtgaaagatggaaaggtacagaggttcaaatatgaagtagacctgggggcatggagtgggcaggagctggactttggcggtagcttgatactttagcaatgctgaggttaattgatgctgtgaacgcatttcaacattagtgtctttgtgactgtctagggttctctttgttaatggactgatgtttccatgcatgcactttatcaaggctgctatggtggaaaggggtggcatttccatgtttatcagggtttttcctttgcattcccttcattctccctcataaaagtccttgagtgtggcactgtccattttattgatgagtagagacactatgctgtttactttccaaaatcagacattttgagagtgtaaggggggatggtattaatagtcacgtcaggatgtcaggcataatctgagagtgtccccggcaaactactgatgagggcacaaggtaaaaactcttagctaaggtcccacagctagtaaggcagaggcagaggtggaatgatggttaatattgagtgtcaacttgattggattgaaggatgcaaagtattgttcctgggtgtgtccgtgagggtgttgccaaaggagattaacatttgagtcagtggactgggagaggcagacccaccctccatctggttgggcaccatctaatcaggtgccagtgctgctagaataaagcaggcaggagaagatggaagcactgacttgctgagtcttccagccttcatctttctcctgggctggatgcttcctgcccttgaacatcagactccgagctcttcagcttttggactcttggacttacaccagtggtttgccagggactctcgggtctttggccactgactgaagggtgcactgtcggcttccctatttttgaggttttggacttgaactgatccaccactggcttccttgtgcctcaacttgcaaatggtctatcgtgggactttactttgtgatcatgtgagtcaattctccttaataaacttgttttcatatatacatctatcctattagctttgtccctctaaagaaccctattataggtgggatttgaagccaggtctattgggctgtccacggggtcctctccgtcaaggtgaacaccttaaacaaacacatctaccatgtgctgaccacctacagtgtggccttccatgcagagctatattgactggtaagactctttctaggtaggtggtcttatctccaatttacaaatgaggaaactaaggcccagaaagatggattgcctaaagtcattcacctaatttgtggtagagatagaaattgataaatggtttttctcctataccagccatgaggccaagtgagggagcatagagactgaagcccttgttcagattaaaacaggagatcctgagggtgacagaacaggtgaagtgaggtctgctttaagcactctgtgcacaagtgacctcatcagcctttgctactgtttctgacttctcttggaagtttcttccagtgaaaagtgagcttatttttcttttccaggtgtcttcctccaacttgcacagcctgcagctcctattgctgtcacatatattaatgctgatatcaaagcccctgctggaagtcagggagcgcctgctctctttgcagaaccggcagccccaggtgtgctatctttccccagttggctgtgacaagcggcctctgcaaggccgaaccatttccagatccaaaagctgaataccccttggctgcactcagcccccagctcctgagggtgtggagagcaaaaaccttcctgctgagccctgacagctgctcagtctgggcccctttccacagcctggcttcttcctgccaggagaaattcatcttttcacagcagagggagtgagaacagcccgcagttcctgttggatggcacctgctatctctctgccccctgggtagtaccaggcgttctctgtgggaaatgcccttcctcctccttctcctccctccctgtctgcctgaaaaatgactcaactttttcaattcactgcacatcactacctcttccctgccttcgaggctgttggggtcttcctctgttcccacagcccctgcccagccatctggcacagcctcctgcacacagaaggacactacttgtcatccttatggattcatgagtggtgaagcgacagacctggcacagatgaggtactttgtgagggtgttgaacgaagatggggagatgaatggatgggtgtgggaacacatgaacaggagtatttagaaatgaattaacgactgacccagtaaacaaacgaacaggtgaaggaacaagaactgatgagctgaaaccctgccttccccaggacaggactgactttgaacttggcttcaagactcattcatttcgtccctttaggagtgacgttgtccctttcagggccccacctttcccatctagggctggacttcaggccagcctggctcccttgtgcacctcaattgatgggcaactcattcctttttgacagagagtccagttttctgatggagcccaaatatgagtatcgattgtctcccaggcccctgatcagatatcacaaccccgggaagtcctccctgaagcctgaggctggtgcatgcatcttcggagctgcgatcatgaatgctgaatgacacacggggcctttgtaccagctgctcctctgcctggattgctcatgcgcagatgtgtgcgtggctgcctccttcttgtctcctgatctctgctccatgatcaactctgtggagaggccttccctggctaccctaagatagcattttctccatcattctcctcctcattttgcatgacttctcttctgagcacttattgctacacgtattagtctgttctcccattgctataaagaaatacctgagactggtaatttatattaaaaaagaggtttaattggctcacggttccaacaggttgtacaggaagcatgatgctggcatctactcagcttctgcggaggtctcaggaatcttccaatcacggtggaaggcaaaggagaagtgaggtgtctcacatgatggcagcaggaacaaaatagagggtggggaggtaccacacacttttaaacgatgggatctcatcgtttaaaatgatgatagtgagaactcactatcacaaggacagtacaggggggatggtgctaaaccattcatgagaaatccaaccccatgatccaatcacctcccaccatgccccacctccaacactggggattacaattcaacatgagatttggtggggacacaactccaaaccatataattacattatattttcatgtgtttacaataagcctccctcaacagaatgtccattccttgagggcagggattttgtttgtttgttttgctccatgcactgctccaatttctacattatctgccatataggggctcctcttggcatatggggcctctataccaatagtttctggtataggggctcaataaatatggataagtgaatgaatgaatgaatgaatgaatgaatgaatctggctgtgtcctcatccggagagtcttattcatctttgcatcccctgggtctagtatggaaccaagtatgtcgtaggtgcttaaaaactacttgctgaattaatgattaaagtacagacacatctttcacattttgatcaaatccttcctctgcttcaaatctccaatggcttcccatggtattgaaagtaaaattcctgattccttaccacggagttatgagatcttctatcctccggcccctactatccttccaacttcatctctttcctttgctaatatggaacatcataatattccaccccaaaacacgaagaactgttgagctgaaggcatgtaaaaagaagtagatgcaggaaggctctctgccttccctctatttgcctaaaagcaggacatagatttacaaagacaagagatattctgctcccaccctcttctgccagggagaacaaagggtaaccagtgaagacaactttggatgcttataggtctggagcttacaccagaggaacctacatgaaccagtttccctaacccacctcgatctgctatttatttgttttcccccaagttgctgtcactagagactcaacgttcttttcctttgtcttgttgcttctttcaacatttactgttctttctcgaagctggaatttaaagccacttctttgagcactactcattccctgggtgtctcccatgtatgtgtgaaatatacatgttaataaacttctgtattttttttcttgtgttagtctgtcttttgttacaggggtctgtttcaactaaggacctatgagggttgaagaaaatatgttttttatcccctatgctaacaacactgcagcctttcctgagccttccaagcgagttcctgcctcaggacctttgcacattcttcccctacatcctcacagggtggcttccttctcagacccaagtcctgcctgcagcgctagcttctcacggaggcccttcctgtccatatcacaaaagcagtcctctcctcccatcaccctagccccttaccctgtttattccttcctagcactggtcagtaatcctcaatatttattagcttaccagtaatggctctataaatatacatttgtagtggcctgtgtcattcgctggggtatctcctgtgcctggatcaacataagaagtgcttgattaatacttttaattaacaaatgctcttgcctatcaaccttgcttttccagctcctttctattgcattggacaataaagcacaatgaatgtgccccgcccagggaggccaactgttatcagtgtacatgtcttcttgattggattatgagcttgacggggaccgagaaatgtctctgactctacttctgtgtcatcagtacagagtgtagtacctgatacatagtatgtgttcaaaaattttttttgttttgagacagggccttactctgtcacccgggctggagtgcagtggcatgaacatggctcactctaacctcgatctcctgggctcaagccatcctcccacctcagcctcccaagtagctgggactacaggcatgtgccaccatgcctggctaatttttaaattttttgtagagatgaggtcttgctacattgcctaggttggtcttgaactcatgagctcaagaaatccttctgcttcagcctcccaaagtatcggagccactgtgcccagctaaaatcttttgttgaatgaattaatttggggcatgactgagaatatataaaaggggaaaaatgactgtgaatgatcagcatatatttcagaaaatcctgcattaaagcacatgcattagtttcctcattaagacagcctccccataggccctcttaaggcataattctgacaagcttgattttatattttaatctatattttgtttcaataaagaagttgggcatgcaaagggaagcacctaaggggtgagagaatgcatgtccgctgaccactcttttgctcgctagacctgatgaatgagacttcacagtggggtgagaatttccatcagaggctatgtgggaacaagagtgactttactttaaatgctaatccaccatgtaacttctgactaaccccacgtccaggaatgcctccaagaagtcgagttgatgtattgctctttatgtagaaacatctattcactgtaagtttcctccaaaacaactcttgatgctgttgcagaaatcaaagactgtgatgcctgcagccacctacacattcctcccagagtgcatacactttttccccagatctaggccctgggactggggggttgccatacagagatctacctgtcttgtggcttcccaagaccatgcttcagtctgcaagttcccctaacaaatcaccctataccatcagactggacttgtctgcccctttctttggtttcttggcttcttctttgccatttggggattgctttgtgtacacagccatttcaagaaacaggctgccactgtcttagaaaaacaacccctggcacatccagtgtgatgccctctcagaaccagttttcttctggaaggctggtttgatttagccaagacactcatgtccccaaagcttcttgacagcagaagtgacctcctgcaagtgcccagagctgtagagctggaggggagctgccccaaacagccttctgctctccaagggcgattccatcagggttagtttccctaagacagaaggcagaaccacagcttagggaaattcttatcatagtcgccatttcttgagtgctttctatgagttggaactttattgtccacctttcagagatttgttttaaactcagaccctgcaaactgtgcatcatcttcatactatagatgggacctggcttaaggtcacacagctgttaagcagggtcccagctctccaaacccaagcctggaagagtacaaattctgcagcttctctacaagctatccatctgggaagcataaaagagagaaaatgccatttcatatttccattttcttcctgtccttgtatacttagagcataaaggatgctgtggtagacagaatataaccccaaaccctgtgcctgtgttgtctcgcatggcaaaaggggttttgcagatgtggttaagtcgaggatcttcagatagggagattatccttgattattctggtgccttgggcatggtgccttggccaggtcttggctggaagccaggagaaaggttggagtaccacctgcttccacctcttctgagctgtgagcatgaacacttgagtaccccactttttgactcacaacccacaaggtttgagaccaacttgccccaaatcacacattaagaaggaggtggagccagactggtctgagtcccaagcctatgcttcttccaaaacaccaggttagaacagcggttcatagccaggagtgattttgcccccagggaacatttggcaatgtctggagacatttttggctattacagctaaaggtaggtgcacctatcagctaatgtgcagaagccaagaatgctgctcaacatcagaccatgcgcgggagagcccccaacaacaaaatactttccagttccaaatgccagaagtgctgaagtcgagagaccctgtcatagatttttctctagtaagtcatgtaatggcatcattaaactatcacgtgctcatccttttggtgggtttgtgaacaaaacaaatttgtatgagaccatttatcatttctttctagaactctgaatttataatttatattgttacagagtacatttaaatctgccttaataaaggcaaggaggcaaagaaggaaattcaaactcactaagcaccttctgtgtaccaggcaccatacatatcgcttagcagtctttatatagttcttcttgcataatagctctcaaggtggaggcttagggaggctggtgactttccaaagacatcacacatggctggaggtgtagcctgtgtctgacccaagctcatgtctttctctcgatgccacatggcagggctgggtttcccaccctttccaggacataaaggaagggagtgggcaggagctggttttgttagacggtctttgaagatttgccacaattggattgatgagacagcccaaggtccctgcaggaacactggtttgcaggaatctggccccggggcccatgatttgccattttggcaaacagagcatttcaaagcatatggctcccagacgcaaggatgtgatacagagaagtgaggcacagccgagcacttcacccaggacccctctgcctccaggtagtggtttcattcctcaagccattcaggagggcaaggagggacttgtggcatgggggaaagggccccagtccttgctttgatactgactgcaatatgcagggcccgttacttattccccagctttctcatctgtaaaatgggtgcactgatccaacagaatggatatgaacatggatgctaattactattgtattattattataccattattattattaatattattattattattattgaaagatctggctcagggcagctcccctctgttgagaacactctgggcacacctcctccaatatgttaatccacacaacagcccatgtgatcatttgaaatagaattgagatgaagtctgtcctctgatgcaaacccgccaagcgtttcccattgcatttgaaatccagctgctgaactgaccaagctctgtggccatggagtttgcttccttcctgctctcttagttttccttcactttgaccctgttgattccattccagtcacacgtgcctccttgttctttctacaactgcccagtattcacgctcatgtcagtgacaacccgagaactggggaaggaagatggggctgagacctgggatcccaggcaaaatggcacatccatggatacggggacgatgctgccattactcctcctaaggcaggagctgtgaggaaagcagtggcagccagcaccttggacgtactccccatccatgcgtgtgagctgcatctaactcgcttcatgtatgttgtctcctcacagcacctagcacccattttacatgtgggtaaactgatgcatgagggtgggaacaggccagcaccactctactggttgcatggagaattccaaccatggtgggtggactctgagctcacagtcctccccacttcatgttggctgtctgggaaaatcatcttttgttctttacacatccacttttggagcctagaatctcctgaatgctggtcacactgctcccaatatggggagacgaacagtagtccttcaagaactttttgtcagcgtgaatcttgcctttcctcagtttaacagaaaaacaatgggcagcgtgtgaatgcaatgggcacttttccatcctagcagtttatttttgacacctcacagaagtgaatcattgtcatgtaactacatctcatttgcaaaagtacaaattgaaacagagttaatgccaattccctcagcttccataagagcttggtaattaaagctgctaaagaagaaagaaagtagacgcagtgtttccttcaaggcctggttccgctccccaacccagcctgcactctctgcagccatgtgggtttctcatgtcagctgaggcggctggagtagaatgtctccctttctttctcaactaactcttgagtttcttgtgaaaggagataatgcaggtaaagtacttaattccatgcttggcccataataagtactcaataaatagtattggtgataatgatgataatgatgaagaagatgatgatgattattttgacattaggaatggaagagaaagcggagaagcagggaagatttctgtagagatagacgggcggctattgctaagccataagcccctttccctcgccccatcatggggagtacaggggagcctcactcaacccaagcctgggaagagggactcacactaccccctgagagctggggacaccgtggatggaggtctgactgcctgactgcctgggagagagatgggctaatgatcaactgcttaaaacgatgtaggggttgaaataatattcctgagatctaatggactgcccccctatgcaggggactaaacattaagcctctgcatgctgatcccattctgtgaactggtgggagtgaattcacacatgcaactcacatgcgtgccccccccacccgaggccctggaatgcactgcccagacacactcaattacaggcctctgagaacgtgccttgcacagtcacacctcggcaattctgcccatgctgacttctccaccaggcgtgtctttagcctctgtcagccttggagctgaaagatccccaagtggtggatttgcgcctgacccgggatagtcccatgccctcctctgttgtcctccaagccctctgctatgttcctgctggagaaagcggtctgttctggtgggcattagtcaagttccatctgtctcccttaccagagcgccactcatctctgatggggccatgcccagaggaggggctcaggagtgttctgacctcagagtcgcctggcagtgcagcctggtgccttcactagtccactgtggcagggcaggcagctgttcccataaactcccttgggcaggtggcccatcatgtaattagaagccaggtgacctgataataatcaactcctgcctggctggaaagcccttgactttaaagcatccagctaaccagggcttcttccccagaattgtttactaccctgaaggggaaatgctatccacccatttatttcaattgggtacctgcaccttcataaaatggcataaactaaacaagaaagtccctagagtcctctgcaccccagttgtcacctgttgaggagctcatatataggggatatgagaagtgaattgtctgtggagctgacagccagcttgaagctctccctctgtcaccccaggaacccccatacctgtgggattaactgagcgcttcataagcccagagcagaacttctcccctcagcaattttgtgacgaatgctgaagattttggaacataatgtttattttttttcaagtttgaacattgagataactaagtcagttcatgtttgcattacattttgagcagtggtgaggttcccagggggagaacagctctgtgtctgcaggaacaccccccaaaggcatgggttctgattccctctagggtcaaagttgctgacatataaaggggaatgttttccttcctccaagaggttattccctgctcagccaggctccctgatgtttttattttagtgtttatttaacccacaagtgaagacaatgaaaatggtcaactaaattctatgtattgacagagcctattggcaataatgatctcatttgactctcacactaatccgtaagacagagacagtataagtcgggatctggacttttccacagagaaaacggaggctgagaagtggatggaacgggggagtggtctccagcctcaggtctcagcatcaacctccgtctccacccagcttctagaatcaattctcacatgcaaacctggtcagtccatgcctcctgcttaaaacccaacagtagcttcccactggcttcagggcagttctacacattaaggccttctgtgttctaatttctgtctacctttgcactttcaccagctgctggttcccaattccaggcacagtgtcagtctcctgcctctggccctgggctcctgtgctcctccttcctcttacaatgccccctcctcacatttgcccagtgaactcctccctgctcaccttgctagaccacggccaaccatttcctgctctgggactcttatctgacacaccaggcagatgggatggcttggcaatatgtcaattattactcttatttgattttacgccaatctttctcccaagggtctggtggctgtcctctgctcatctctgtagcttagacctagcacagtgactggcagacagtaagtaggtgtccaatagactaggatctaacttgaatgaactgtttttggtagaggaggccaaagtgtttatcaaagcatatgagaaaacagatgcttatctctagtccagtgcagtgggctgagtggtggccccacaaatatacatccatgtcctcatcctggagtgtgcaaatattactcaaatggcaaacatatgattaggttaaggatgttgagaggaggacctgggtcctaaatgcaatcacacatgtccttgtaagagtgtggaagatggagttttgggatgcacacataggggaaggcctgtgaaggtggaggcagagactgtgtagtgatgtggccacaagccaaggagcactggcagctgccagaggccaggagaggcgtgtggaagggactcccctcagagcctctgcaggggcactgcatccctactgaagcctcgatctctgccttctggcctcagaactgtgggagaacacattgctgtcatttgtggaactttgtcacagcagccacaggaaatggatacagcccaacagaggactgtgttctcaccatctcagcagctgcaaggaataattaagtgacaaattcctcagctggattcccagggattgcccaagtgacagtgaagaggaagacagctgctgacagaaaccacgagaaagacctatgagcctgacaggtgtcactgatttcaaggactgcagagccagttttgaggttttctacatttctgttgaaaaccccagcatacgcaccaaaactttgaagggctcaaaatctttctcagagcagcatttgcttggactgcttctgaggggagaggttttctggagggttttggcaaaaaatcataaggaacactgccacgttttcgcattcaagtttcaggcgataagctcactaattaactctgccataggctgcgggaaagtgataagtactaaaaccgaacatgtgaaaatgcaagggagaacggctggaaaaaggagactttggagttgggcaggcatgcgttcaaatcctggctgggccacctaaactatgtgccatgagatgtggcccaagcagggctccctggagctgtggtgtcctcatggggagaggagggtctccttgcggagactttgtaaggattagggtgagtgtggccaagtatctagcgctgaccaagtgcttaacttaggaagatttttttggggggtgtgtggggtcttgctgtgtcaccccagttgcagtacattggtgtaatcttagctcattgcaaccttcaactcctggactcaagagatcttcctatcttggcctcccaaagcattaggattataagtgcaagccactgtgcctggcttggaagataatattattaattttaaaagttccctggtcttcttgaaaaagcagaaagtgcaccataaccttggcaggcagcttgcccactcaccattgtttggcattaagagtcagatggtggaaatcactcatttccaaagccctggtaccctgcatctacagctatgtagaggattaggaaatactttcctgccaacttagtggctatattcgttttctagggcttctgtcacaaatcaccacaaacatggggtcttaggagaacagaaatttattctgtcattgttctagaggcagaagtctaaaatcaaggtgttggcagagttggttctctctgcagactctgagggagaaaccatccacgcctctctcctggcttctggtgctgctggcaatccttggtgttcctttgattctagatgcatcgctcgctctaatctctgcctccaccttcatatgcccttctcttccctgtgtcctctccttgtcttatacggacaccagacattgaatttaggggccaccctaaatccaggatggcttcatcttgcgatccttaactgagtaatctgcaatgaccttatttctaaccaaggtcacattctgaggttctgagagaacaagaatctttgggggatactactcaacccattacagtagctaagagcacaaacactgccaacccactgacttcaggggcacctgccccataaaacctatgagttatgacctctcagaaactcagcccttcatgtgcaaagtgggaataagatggtctgtctcctgggctgccatgaggattgaatgaggtgaattgcacagccacaaggttggtagatctggccaccaattctggaggcttccatgctcaggaaagtggcttgggctgggatggctgctgaggaatcattcaggaaatatgtggaaatgctgtccctaggcctcctcagcagaacctggatgaggtccctcctcatccagggacccgggtgggggatgtttccccagggaagggggttctgaagtgcagccatgtagttagagagcccttaatctggttcatcccctcatttcactgatggtgaaactgaggccagagagggacagggacttgtccaacttactgtagattttgggaaagtcacagcaaaattccaagagcatcccagaccatctctcctgtgagttggggcagggtgcagtgggatgtggtacctctgtgtcctggccaggaatgagggctcagaaatgccatgaatgaaagtcacattgtcagctcaaggtcaattcatcaaaaagcaaagactggtaaatgcatttttgaataaaaatatgttaacaaaagaaacccagtctgtgaatgtgcaggaatccctctcactatctgaacctttgctatccagactcctgttttccaaacgcttgaatgaataaattcgataaatgtgttgctatatcgcttgctatccaaatcctatttcctgttgtatgcataaatttctggaataaaatggatttggaaagggaaagatatatatattctttttgtggataaaagtatattttatgccacttggctgaggcttctctctgtttactaacctccagctataacaacagggaactgaagcagaaggaacaacaacaaaaaaaacattctacagaattcactacgcagacatgatgaagaacttagaaactgatcaaagctgttagaaccattccattctatgcacaaaaatgtacattgttcataaatagttaaaagagataaggtaaatccagcaaattgtgtttctctatgatttgactttcagcaatgtgacctctcagtgcattgacttttgatgaattaactttcattaagttgctttgttttcttcacagctaacagctagaggggtggacccttggaaatgaccataatatgttgagactgctggaatggtcaaggtcttcaacattcccctatagcctttttgcaccatagcaatttgtgtccttattgaacattcctcagaatactccagtttgagtgtaccatatgttcccagtggggaccctgacccatgactgttattgaaggtaagatccctaagggcagagactctatgtgtgtgcacatgcatgtgagtgtgtgtgtttgtgtgtttgctcctccactgcatctccaggcctagaaggaggcccactttctagtaggctctcagtgattatttgtggaatgggggtaagtgaaggaaagcccataattctcatctcttgcctattctacagttactgcctccaggcaattgtagaatagccacagttctttgcagcccctccaatgggagggaaagtctttccccatcccttgaatctgggcgggctttgtgacttgctttggctgatagaatgcagcagaaatagtgtggagttccaagcccaggcctcaggcagttttgcacacttccccttcttttcttgcaactttgccaccatcatataaacaaacctggtctagtctgtgggacagtgatggacatgtggtcaagttacccttctcagtgccagaccaatgagtgaggctactttggactagctggtgcccagatgacctgccagctggatgtagataggaggaaatcatctagctgagatcaaagaagcctgggccagaagagcaaaactgccacactgactaactcttgcgagcaataataactggttgttgtttaatccatgaggcttggcggttatttgttacacagtcatagctaaccgatacaaattccttagtgatctttctgaattcactcttcccaagcctctcccatattccacattttacctctggtttattccctcctctgcagactttttaaacaccagtgtgataatgctatgtcccagctcaaaattctttggtggctgcccacttccacaaggacaaagtttaattatttcagcctgtgaggcccacgatgatctggccaccactttccctgcaccctgatgtcccctgaggcccttttactccagagcgtctctccagttttacatgtgtcctaggcttccattagcatcctctctgatgtctgtcctctactcagacattcctccttttccctttagctggctacctccaggtccacttctagctcaaatggcacttttgctattaaaaaaaaatgcccctttctcaaataaaatattttacaagttagtacattattgaataaacagaatgatcacaccctgtggccaggcccagccttgccaggggagttctccagatgccctctctgatggcagcagccctgcagatgcacatgtgtacccccacagctgtctgcttaccccacccgtgagccagtgtacacctaagctctgtgcccttcccacaaagtggagcaccatgccagttttggaaccgcgcagaggatgagaatcaggcctctgagagtgggctagaaaggaagctcagaggccatctggagaacggagtgcacatgtgtgtatgtgcatgtgtgtgaatcagtatatgtggatgttgtgtaatcccagctgtgtgcatgactgttttgcttgtgagttgatgtaggagatggtgcagtcctgttgtgtcagaacctggctgggagacctcacatccccacatcggcacccatgttctcacaggttagtgtctaaggtgggatgctgtgtctttagaaatggccataagttagtgtctgtctaatgtgggacgctgtgtctttagaaatggccataagttagtgtctgtctaatgtgggacgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttagcgtctgtctaagatgggatgctgtgtctttagaaatggccataggttactctctgtctaagatgggatgctgtgtctttagaaatggccataggttagtgtctaagatgggatgctgtgtctttagaaatggccataggttagcatctgtctaagatgggatgctgtgtctttagaaatggccataggttactctctgtctaagatgggatgctgtgtctttagaaatggccataggttactctctgtctaagatgggatgctgtgtctttagaaatggccataggttactctctgtctaagatgggatgctgtgtctttagaaatggccataggttagcgtctgtctcagatgggatgctgtgtctttagaaatgtcttcttgtgcagtgcacaccctgagaacccatacttggtggctctgcttgctctgactcgatatttagaaatcagtctaagttgtacctcctctaggtaacctgacatccattcacccagacacacatctcctctgtgctcccttagtacctgggacctgcctttagcttagttgcctattgtagaccttaagaactctggctctggagtcaaactgataggaagtggaattgtggttcactgctgtgtaatccaggtaaagctcttaaccgctctgagtctcaacttcctctatccacctccccttttccccccagtgacaaagccaatgactacttcttcctcttctttacttggaaactgaactccaagctcctgattgggacatttcttattcctctttgtgctcccagggctgaaggactaattacaatgttattgacttaacctccattggcactgggcattgccctgtaaaaggacatcagagtgtggggtctgacatggggcaccaaacaaagccataggcaagagcacatcacattgttgaatttgcctgtttggttctcagaatctcaaaatagtttttgataaaagcggaaatgaatctctgccatgctttgtcgacaggggtgagaactggttcttgggaggtggcaagaagtcttaaatatcacaatggtttgcagagctgcaaaagcttagccctacctgatgaaatcttacttcttagtgtttatattcttctgttatggagaaatttaatgaaaattagtttacccctgaggtggttgaagcttcccactgttgttcgtcccaaggggcctccatctctctctggttccctatccctacccacagggctataaatagtccattcacagaactgcttttaaaatcctggcagtgcatgcttgtaatctcagcactttgggaggccaaggtgggaggataacttgagcccaggagttccagaccaggttgggaaacatagcaagactctatccccacaaaaaaatttaaaaagtagccaggtatggtggcatgcacttgtcccagctactcaggaggctgaggtgggaggatagcctgagtccaggaggtggaggctgcagtgagtcatgatcacaccactgcacttcagcctgggtgacagagcgagaccctatctctaaaacaaacaaacaaacaagcaaacaaacaaataaaaccctcttgactgtatctcctgattccctgattcctgctggacctggatgaaatttcacatttatataatagtttagagttcacagggtagttttagatagctcatcttttaagtcccttccctaaaagcctgtgtggtaatgggtgtggagtctgagtctttgtttctagacagggactagcaccaatgctggagttaattctcaccttctgtacgaattcattttagagacattgatgtgtcctgagcaatggctactatttagttttaagtctagatttgtgagacatttccatttaattttcattaaacagtttttcaaaaattatgactatatgccaagttggtgtcattatgtctcttaacttatagctatagttattttaatgtgcatatatttattccttctatgcaatactttctgcttggtccggaggattagaaagcaatttgtcattctgctttgcacacaattccctaacttttgaggggaaaggagacatctgattcgactccccctaaagtgctgggatacttaaggtaattggggtgaggccaaggccacggatagggttctttctttcatctattatttgttcattcacttgtttattcattcaacaagtaagaatgtgcccgtacctgcctaagcaccccatcccaggcagggagaccttgctgtctgctggctgagctccctcttggggcagtgcaggctggtgcacagagccctcccacccaacttggggtagtgcctgcccccctggcaggagattcagaggcagacatatctagggttgagtctggactccaccttgcctcttttgagatcatggattcaaccttgctggcatgagagaattgaaagggatcatgtatgaacaatgtttggacgaatcccaggcatttgacacacatgggttccttcttttttccctctcctgcctcctgtaaatccagtaagcaatacttattcattcccaggtctgtctcttctgtgggctcctccagcataggaggagttaaaggactgagccctttcacttgcagggcagggccaggatgtttcatggtttcttctttccagatgttgcaggtgcaggcctggcattgagataatgtcatacaagtgggtggctttgactctttatgttatctgatgctcctgccatcttcctgtcccaggctcttctgggtctgctggacacagcctttaccccttctggatctcaccaggctcctgttggggcacacctgctgtgtgcaatcctaagagcctggctgggattctcaacactgtttgcaggagggtttcctcctcggggtcagccggggccagcagccaatgcagttgagagtgccagcccccttcctcctatagaatgtctatagtggtcattctcaactgtgccctgtccctctcctcttcctctgtgggggtagagacactgtcttgctcatccttttatcttcaactcccagcccagggctggcactgtggcataacacacacacacatatatatatatataaaattgcaatatatatatatttgatttttgtccctagtttttggcccagatttcttaaaagccttgggatttctggagtaacaagagtggcttttgtcatttataatgaacccctaatgtggtgactcaggtgggtcattagatggtttcaaggcagcgctggccatgcttggagggttggaaccttcagctccatcttccagcctctaaggaagggagaggggctgcaggctgagttcagtcaccagtggccagtgatggaatcaatcatgcctatataatggagcctccatagaaacgtctaaatgatggggttgaggtgtttcccagttggtaaacgcactgaagtgctgggaggctggtgtatccacagagggcatgaaagctccatgccccgtgatgcacccccataccttctgtatgcctctcttccacttggctgtttctgagttgcagcctctataataaagctgtaattgtaagtagggcactttcctgagttctgggagtcatgctagcaaataattatcaaacctgagggtagccttgggaacccctgaatttgtagtcagcagagcagaagtgccggctccctgggactctgtttttggttggtgtctgaagtgagggcagtcttgtgggattgaaccctttaactctttctgacactctggggaggcagtgtcagaattgagctgaattgttggacacccagttgttggtggagacaaattgaagaggtggtgtggaaaacatgtgtttggtgtcaaaatacacacacacatttggtgtgagctgtggtggtagaaaacaccacacaccacacagtaggaacttaatgagtatgttttgaatgaattcatgaaaaatacaagcatttattgagtgctgacccactgtcaggctgtgtgtttggatacaggtgatagaaacaaggttcttgtctttgaagcagtccctgatgttaggaggactgaccaaccatggccattgtaatggggtgggggtggggatacactaggagttaatctagggggctgtgggagcccagaggggcgggctgtttctaagaaagtctcaagatgcagtatgagctgactttttgaagatgagaagccacacctcaaatggatgaataagggtggttgttgcaagaggggaaatagcacatgcaaaggctgagaccatgaagcgtgtgtgtgtgtgtgtatttatgtgtgtatgtgtgtgtgtgtgtgtgtttgtgcgtgtggggcagggggcagctgcctgtggctccagatggctgcagtgcagggagaatgcgggatagagagggagggcaggcagggcaggcagagacgaccacataggttctgtcaaatgctgatacgcccctgcagtctttccagaggggtcctttttccaagcaaggtatgtgctgaggcatcttccatcaggaccgctccatcttctggggtgctcagaccttaattcgcaccttgataatggcagtggccttaccgctccatcttgtttgcatctgtccactccatttaaacacaaactccccatagaggacttaacttggtgccaggcacagagtcagggcttcatgtgatttttaaaactggaattgacacattttggcaacgatcttctttttttaaaaggtgaagctcttttattttgcctcatttattagacttccctgccactgccttggggttatgcacacaaataaaatatgcagcaggaaactgcctctcttgttttctttctttgctttcacctaatttcaactccttgtcaagtcttcttacatcgacctgttcctcacagaagctgcctcaggcggcctcctggccctctcctgggagatccatccctcttctttaatcatggagagcaggcccatgagtctctctgccattcagctctgagcatcttcctgccacactttcccgggtggctcccctggggacttgctcttccctgtccacttaggaagatgcaagatggtctcatggtctaagtggcagcttttcttagacaggtaagttccctgaggctttaaactgtacactctcaatgtgagtttaaatgaagcttctaaaccctggtccatcttgtggctaaagtcattgctagccagcgaggcccaggtgctgggtcaacacagggggttgaagatggattgaggaagcggagggcaggggctgacaggtgatctgggattgggaggtgcaggtggccttccctccagggagtcccatagacactgatggggagcccagcatttaaagccctggaaatgcagcatgttctacagtcaaaagaaagccacagttgcaaacacttggaacagaatcaggatcattgcaaaaagtcttgggagggcttaggaaaaaaaaaacagagaaggctaagcttagtgatttttggttagcaaagaacttcaggcagatatgcagatgagtccaatctggcttgtttgtgtgcatgggtggggaagaaggtcaacttttcactcagatacaatgctgacatttaccgtttcttctgggaaaacagctgttatggaaaaagataactcgagaagcattaaatcacaccatgaaacatacagctttcttgccctcatgacctgcacttatcatagtggcaatgcccacacctttgcaggggtggcactgtcccagataactgccctgggctggctgctccaggcccctggctggtgtctctgcctccagtttcttctcactgcaggtctgccctgtgaaattcatgcacacagactccccaacagacctctagtgagttccataaaaccgcaaatccttagtgcaacagccaagacgctctgagatttgcttctagcttatctcctgactcctcctctgtgtctcaccctgcactccggggagtggttcctgacgagcacttagctgtcatcagatgaggcctgaatatcaatgtttgctttggttttctttctaagccaccaagtgatggtaatatattcagccagggtttaaaaactgctctagcccagtggttcttgaacttggctgcaccttggaatcatgcagtgttagaaaatgccaagcctgggccctagccctccaagattatgtcttggttggccttcagtgcagcctgagcaccagggctttaaaagcttcccaggtgactgagcaatgtttgagcaccactgctgtggctctgatggtttatttaaggttcgtttgacatgaacttcttcctatattctggcagtggctgctctcactgcctggaaattcctccttccctacctcaccagctagccctctcccaagttccaaatttcagagctgaggaactatagcaggggttgacacatgtttaaaataaaaagttagaaagaaaatatattaggcttttcaggccacatgtggtccctggcatgcattctttctttcccccttttaaaatgcaaaagccattctttgctggtgggtcacacaaactaggccagggaccaaatctgacctgtggacaattgaattgcctgttttgtgaggcagtgggttccctgtcaatagatgcaatcaagccatggctgaaggaattcctggcagggaaaccatgactaggacttaagcttctgataaatgactgaactagaacatctttacggtcttttccaaacttgggatgccttaattctaattcatctcagcccctggaaggtttcctcatctgccagatgacctccctccagcgctgaagtcattcccatgttgtgttccgcctcagttaattgtgaagatctgcatgtgtcagcacagacttcatttcaaaaccaagtgctatgatttaggtgtctttgaatttaagagacaaagaccaaagattgttcttgacctctgcattgagataatacctgaagcaggaatggctggaaccatgaaaatcaacatgcttttaattcatcctcagccaagctgatctgacaactagaaacaaaagacaaaagtatttctttccacatagacacaaacaggactgatttatgaggatcaagagtaaccccatcctgggaagataaaagcaggagccccctccccttatcctcaattctctgtgtaggccatttctccttggaatagtttttaaccttgcaagtaaatttcaaaatgggcataattccactcaatctttagcaaagagctgaggttctaggacaagatggtgaagatttaaatctagcatttgcctcttagctatgtgatttgggaaaaattactggatcattctgaatattggttttttcatctataagaggccgaggcaggcggatcacgaggtcaggtgatcgtgaccatcctggctaacacagtgaaaccccatctctactaaaaatacaaaaaaattagccaggcgtgatggtggacgcctgcagtcccagcttcttgggaggctgaggcaggagaatggcgtgaacccgggaggcggagcttgcagtgagctgagatcgcgtcactgcactccagcctgggcaacagagtgagactctgtctcaagaaaaaaaaaaaaaaaaaggattagtttgggaaggaaggatttagcagctgatctataaaccatcttctatcctctaggacagacagacagaaaccagggaaataaatggccgtgtccattctccacataaacttcctaccccaacctcatgatggtatttattagcagaacaataagggagagtccttatattcacaatgtttttagtgggctatacctggtctacttagatggtaaggtttagctatggggctagcttgctggaaaatgtcagtgttagctgaaaaattatctgaatataaaatgcagaaaatagcttctttcatggaagtgatgcatgtatgtcctttttagagccctcatatgttaaatctggacaactatgcatcctaatgtggcaaagaagaacagcaagctatctacacacacacacacacacacacacatacacagatttgaaaatctgactctattatcttatattcacctagtatttttgtgaaaattaaagcacttagaacagggcctggaatagagtaagtgatcaataaaagttattaccagagactggatttggggacagatgtgaatgtgctatggaaagtccagggtagtgtgtagaggtgaatttcttatgtttgtcgtggaacgaaaacagcatagatttttaacacttgggttcacatcctagctccaacactcactagctgtttcttatcaggggagcccctaacccctgtggacttcagtttcttcatttgtagatgagagtggtaatcctaatttgcaagcccatcttgcacagtaggggtgatgtatataaggcagctggtgcagtgtctaagttaaagttgatgctcaagaaaggctagtggctgaatgccattatgagtggaaactgagcaagtgcggcaaggactgggcaaagaacaggacagagcctgggaagccctaagccactgcttctgggtttaaccaatcactttaagggtgccctgtgggttcagcacctcccagtccacatcttacagcttagtgcctactcagccccttctatctgagttccctggtcatgattaaaccacctgcaaatacgtcctgacaaccttctagatgtcaggccaggactgggcactttaggagaggctgatgtaaaagtgccaactctgcatccagggctggccatgggacttgtcatcaccactggaatacgagtggagaagagggtgttaccccaggtcagggctcttaagaagctttctgcacagtctttctccttttcacctactggatgcagtagaccagagacactcggggttggcagagccacagcccaggaggaaactgggtgcatgtgctcatctacctgggacactagccatgggtggttctatgagtgagacatggatttctattgtgtgaagcttctgtcattcagagacatatttgttaggcagctagcgttacactgactgatacatgctgttagtgactcagaattcagactgcacatgtgaaacattcaaggtgcctgctcaggagcatgttacttttttaaacaatttttttagaaaagagatgggctttttttctctagcaccctggctagagtgcaatgctgccatcatagctcattgtaacctaaaaattctgagctcaagtgagccttctgcctcagtctcctaaatagctgagattacaggtacattccactactacacctggctagaaatgtttttttttttaattagtaaagttgggcttgaagatacaagaccattttttggagggttggcaattaagaagccattggccatctgtgcaacagtgtatttgttggatggaggaaagtgtgggagaatgtatgtgataatagacaaacccttcagttttgactttaaggtattaaaaacctggttctcagaaataccatttgacccagcaatcccattacttagtatatacccaaaggaatataaatcattctattataaagacacatgcatgcatatattcattgcagcactattcacaatagcaaagacatagaatcaacccaaatgctcatcaatgatagactggataaagaaaatgtggtacatatgtaccacggaatactacacagccatgagaaggaacaagatcatgtcctttgcagggacatggatggagctggaagccattatcctcagcaaactaacacaggaacagaaaaccaaacaccacatgttctcactcataagtgtgagctgaataatgagaacacatggacacaggaaggggaacaacacacactggggcctgtctggggtgggagtggagggagggaaagtatcaggaaaaatagctaatgcaggctgggcttaataccttaattgctgtcgataagtacagcaaaccaccatggcacacatttacctatgtaacaaacctgcgagtcctgcacatgtatcccggaacttaaaataaaaaagcaacatgtatcccatgaaaaaaaatatggttctattttatcttcctcctgcctacccctgctctcctctccctccagcttggcatacaacaggtgctcaataaaggcttgagaaattgataagaatggaattcaaccttatatttgttctttctctgaaaagaatcttggtattagcttgactaatccttttgctccatgcaattggctagtgccaccttcatatttttctgatatcattaagccccagctgcctcttccctggagctcagggatattgcaggaaaaggggtctgctctctccacttcttctctcctccaaggtttgttttgaaaaaccctgctgccagggcaggctcccgtgttacgctgctcacaaaagcacacatcttccctgccagcctttgctcagttattttattccctctctaacaagtacttgtggagccttactatgtcttcagcacagttctaggttatcaggataagattgtgaaccacacaccaggtcctttcatggagcttattttctagcctggaggagacacacattaaagacagactgcagcacacaggccgcatgcagcccactgcctgcttttgtaaataaagttttactgggacacaaccatgcagtccattcatttactcgttatctatggctgtgtccacactaccatggcagaggtgagtagttgtgatagagaatgcatggtctgtgaaataaaagtatttacacctggccctttgcaggaaaaatcttcccatgtctgcattaaacaaatgagtacgcaggaaaccaacatgcctgtgaacaatgctatgatgggtgatgagatagagggtaggtgtgcatgtgtgtgtgagtgtatatagtaaatgtgtgtgtgctggttttagaataagtggccaggagaggcctcactgagcagctgacatctcagaggggacttccacaccagaggcaagcccctctgggagcagagactgctcctgtctggtttgctcacgcatgtccccaggctagcatagggccgtaggctggacacctccagagcactgatgtgaagatgtggatgtgaggttgtgatgcagatgccctggaagactaaacacatttactcctcgcgtccactgtaaactacaacatgtgctgtgtgttcatcctctaattcgctgccctgcctgggaggtgcttgctttctttttcttgcagccgttctgaccaccctcatagcactgtgtgtgtgtgtgtgtgtgtgtgtgtgtgtgtgtgtgtgtgtgtgtgtgctgtgtgcatgtatgtgcacctgatgccctccccaaccattccatggcccaccttgccaccttgccatcttattataatatcccgatgtcctgaatggacactttccatccaccatgaatgcaatagaacctggaatgtaatggcttacgagaatcagcaacacaaagggagaaacagaagttcagttccctttgttctgatagaaacttactgtttgcatccaccaagaaacacaaccaaagaacagccatgaatatcatcccatgagagagcacatggctgtgtcagaccctgccctgagccccccttctcagtctgaccttggactctgctggaggtccctgctggacgtggacacagggccagggaatggtagggtcctcagttgcattgcatccttgtcgttgtacagatggggaaactgaggctaacaaagagaagaagtctctcctactgacccatggctaggaaacagcagggctagaagtgagtcccaggtaaactgaggctgggatactccagctgcacactcacacagctaccatgtaagctggtggttggggcctgggcctggcagtcaggccactccacctactcgctcatgcaagtcaccttccatctctgtcttctttggcactgtcctgagccttaaatgagctcacacaggtcaagttcttagccaagtataacacaaaatcaatgaacaatatgtcttagacatgattattgccacatctttcaccatagacggtaactgcttaggcacagactgtgacttggttgtctttgattcaacacaaaccagtgtcacctctggatcagagccctcccgcgtatgaactgctcttgctgtgtggtgggaaattatctcccactcatcttcaggtgagtccactttcaccttctgtgggatagactgcagacagtcggctacatttaaattgggccaaaagaaaggcagcagacacacatccccagtcaggctttgcttcttctgggctctgggttccccatctgtatgaggagagccccccagcttggtgatgccatgagtccctgggcggggcagtggggagggtggggtgccttacctggcccactgcagaaagaggcgatgatggccagaatgcccacgatactcaggtaggggacccagggggcgtggtcctgggagagaacagggagtggtcaggtgaggaggtgatggtgtgaccggaggacctgagttcccaccccagctcctcctccatccatctgtgtgaccttggacaggtcacttgatgtccccaagccccagcttcagcatctataacatgggaacaatgataacccttcggtcactccatctgcttattttatagccatgatgaaatcagatgaagcctgtgatgagtttgacatagtcctggcatacaggaagtggtaaataaatcaataactcacattgattgagggcttagttggcatcaggcaatatgagcaattttcacagctttatcacatttataaaagttcatcattctcagcaaactgacacaagaaccgaaaaccaaaccccacatgtctcactcataagtgggagttgaacaatgagaacacatggacacagggaggggaacatcacatgctggggcctgttttggggggtggggggctggaggagggatagcattaggagaaacacctaatgtagatgatgggttgatgggtgcagccaaccaccatggcacatgtatacctatgtaacaaacctgcacgttctgcacatgtatcccagaacttaaagtatatatatacatatatatatatatatgtatatatatgaatgtttcctcatatacattttaaaggcttctatattttgcttaaaagaagttatcttagttctgatattattacataaaggaccttatttgtacccctgccatcttgcaaggtgtgagatgcgttaattcatttcatggaatatgtctggagaagctgtcactcatccggggggtgggtggcttggtgctggttgggattgctcctgctctagcagactggacagctgagcattagaacacagtgtcaccagttctgaatctgtgggggtgccagggctgccccaggagaggccacctgacttgaagggaaggtaagagcctgcgttcatctctgtaggctgagccagagtcagcccagtgggaaaggaaaggaaagaggttccagtagggggttcagcatacacaagggcatagaatcctaagagggcaccatcggcgggggggtaagctgcaaacagtctggagtggagggcgaggggtacagagggcagacagaggaatggggaactccctccttccccttgttctatgtccaaatccattagctttaggggttgagaggagcttcatggactcttgtacactgtatggcttgcttctgtaccaagtcactcactcactcactaattcagctgattgatccgagctgcccctgggtgccaggcactgggatgggaggtggaaatgcagatatggttcatgccaggcccttgccctacacaactcactcactgtctatttggagagagacatgtgccaacagtgaaagtcaatggtatgtgataagtgatctcacagggttcccccttggggcttatgggaacacaggagagagcacctcacccagacttggaagcaaggggaggcttcctgcaggaagaggtgtccaggaatgtccaaggcctcctgagtccagagcaaggagaagctagccaagcacagaagagccctaggagaggaaactgccaggttccttgaggagctgccgggggcagggtgtggggcactggaggagacaagggtggccaagccaagaacagctctgaaaccttgtgaaatgaggcttagatggggtttgtgggcttcaggctttccttttaaacttcggacacaagtttcagaaagacaatggcctggaacatcgcctaactggcttcctgagaactttgaaggactgtaaagatgctggagcttgggacagcttgggcctggctgtcaggaaggaactgcatctgccagcacattgtccctgaaggcaatgcttccacctcctgccggtcagcgtgcttgccagccccacctcttcaaagggcacccatcagccaccaccatgctaacagtgccttcttctagaaacatttgggccactaagacatttgacaggtgatcaaaatgtgcacctatcaatttccagatgcatttttgaaaaatgcaaagattaatcaattgctgcaaccttgcttcacgcttcccatggcaccaagatgagttggaggtactgaggcagtgttcagttaatgcaagctgccctgagccatgcagggggcagaagcccaggatccggggatctaattgccaccttttggtggtgtaaccttgggaagcttatttatttatatttatccctcagtttccttatctccataaaacaaaaaaatactgatgttgtaaggatgaagtacatcgccacccctcctccttcatggacatccactgagtgcttgttccaagtgctttcagtgcattttctcatttcatcccacaacacccctggatgaagggacgactgtttcattttagagatgaggcccggagaggagctgacttgctaaagtttcattacaagtaaggaaaagccagggtccacacaggctgtctggctccagagccactgttcctaaaattgtgacaactagggaagtggctgatatgcagcacctggcactcatgctgggaggtgacagctggaaggagcaccttaaggttgtctagtgcaagctcttctattccatagatgggtgaactgaggctcagagatggaaagtgtcttgcccaagatcacacggctcatcagtgagagtgacaggaccagaagtcaggtctctcatctcccagtccaaggacccctcaccaaaccctcttcactgagaccctcagcagctccagagatgagatgtccccggggagagctttatcacaagtgttttctgtagaagtatgaacccacaaatcaaaggccccaaaacgatgaagccagaagtcagctccatgcttatctccctcaaatgtgacaagaacatcgtctcacctgcagggtcagcgtgatggtgagggtcccaaagaagaggcccatgagcccaaagccaccaatgaggaggggtctccgtcccaggtgctcaatgaccaaaccctagtccagggtaaaagagagagagagagctattattccatttctaaccacaacaggggaatgtggcactgggaaccggcaatggcatcatgattaaaaaccggctttgaccctgagacagttgggccaccttctttatggccacagccctgaagcaatgctctttatgagaaaggaaaaagcgagggagagaaagtcacaattcttgagcacctacagcattaataacgagcactctcctccgaatcttccttgctatggtggactcctccaacagggagtctgggagaaggaactggatggatatggtcaccacagcccttctcctccttcagaggcaacctgcatggaaggtgactcctctgtgtctccatgttgtgggtttcataggggtaggcatccacagcggggcacaggggtgggagtaggcagagaagcccatgtcgttttccagtctgcctgtgtctggggaagtcaatttcattgtgggatgtgatgtggggagtccctggggaagtccctaaagctgtgtcctcgaagccagcttccctcggcctaggactgtcactgacctccatctggctggcccctgtgccccttgtccacttggtcaggaaacagctcctcaactgccaatgactgaaagagtaattgtagccgaatgtcagagacaggaaaacctgggtttatattccggctttactattttccagatgcacgaactttggcatgtcacttcacttcccaaagccccagggcctttatctgtgacaagagaatcaaaatatccttccacaagagtgtctggagtggaagggtgtgttaaataagagactgcactcaacacacaggttaggtactcggattatgtgaggtatcctcctctcatgctccatatcacaaaaagagaacacggagggtcagagaggtgagataacagcagacatcacagagcaagtaggtgagagagggccagaaattgagcccagaatgaatcagaatccatggcttttctcaatgaggcaatcaggcgaggcttcctggaggaggcaggagcagacagagatgtggagagcttgtcaggcagagggattagtgggggaaaaggttttggggctggatggtccccatcacgacagtcatttggcttggacaaggggaagcagtgacgctgctgagggccatgaagccagagcacacatggctcctgcctgccagcttcaggtgacagtgcgaaggtcacagcactgagacgaacagttgcaatccttccccaaagcctcagggtttctccacaatggaacccagctgcagggaccccagtgccctctacctgttcctctttcctcataccctgctccttagagggaggcaggtgagaagccgtctaggcaatgggcgttctcccccaagcttagcatgggctgttgttctgctgggcagagccggcactgaggggtgagtgacagctgcctgtccgaagggcatagccctgtgggtcagctgagcaccccggccatgtagtgctgcctggggccatggacctctcagtcacctgggcatgaatgttgaggggaacggagggtgctggccccgaaagtcagaggcctgggaggaaaatgtgcctggctgatgaccacatgtctctaaaagcatccaagacttctggtcagaaatgcctttctcctgggtgcttagggaagaagggcagactcaagcctttaaacttggcctcctagaaacctggcccagtggaacagagcacaggtgacatccaggggcacaaaagcctgaagatgggccatctgagctgaattcctggctttgccacttagccttctttgcacccaggacaggttattcagcttttccaagtctcagtttccccacctggaaaatgagaatgataataccatttttgcagggtagctgtgagataaagcgaaagaactcacaatgcctgaaatagactcatgaacaaaagaggttgccaataaatggcaggaaatatattattcattttaactaaggagtgccctggggatctggtcccaactcttacccgtagctggctgtgtggccttgaacaagttaattaacccttccatgtcttaatttctcatcttttctgatgataatggagttagtctagataccaatagctaatgatcatttactgagcacctactatgtgccaagcactgtattaagcacttttcatgcagcaactcatttaatcctgacaataattttgagtaggttctattatttgctccattttacaggtaaaagaacagaggcacagagtctttggaaacttgtccagggtcacatggctggtaagtggcaaagctgggatcacctacaaaatcttttctgttgttgtgacattacattttcttgacattaaactagaaacagtcaatgccaccacttggtaacagcccagtgtctcacctggtccagctcccggacccgaacaagggcactgatcacttttctgcccccccaccccctcccccctccgcattcctggctctctgattctctttcttcacttgaaggctaggagccttcatctttgctttcccagagcctggaagaatacctgacaggtgtggcgtaagtgtttgctgagggagggaaggtctgtctttataacgcaggcagaatgattctcatttgcagggggagggcggggagggcagtgaggttcaagaatactgagggacagtaacttcacttggtgggaagtggggagggaagtcaggcccagtgagagtcaggagggaagcaatgaccaacagcttctgagaaagagagatagggggaggcagagagggacggagggagagaatgagggagggagggagggagtgagggagggagggagacacagagaaacctgcatttaaagcatcccttcctcttaggccctcatgagctgggtttcatcaaagaggagacactgatggggctgctgtgccaggtccagtgcaacatgggcaagggagctgggtcctagtgccaggagggacccccgcaaaggtaataggagaaaaggcccagagatatcaggggcttagagagattatgaaattatgggcccagagagattatgcttatctctgtgtaactcatactaatttcagtgtaacaatgcaacacatgttaatctcagcgcaacacatgttaatcttggcgtagcactctcagtgatctgggcccaggatcagaggccaagagtgattatgggatttaccaaaagtcacccagggctaactattcagagagaaggaagtgggatagatgctgttttacaccaaggggcagttgcaaacgtccacacccttggactcagtcactcaccttctgggcattgatcctaaggaaatagatgtttggtcaaagatgcatggacaacgatctttgttggtgtgttatttatactactggggaaatagaaataatctagaaatccaccaacaattagttaaataaatgctggaatatctagatggtaaatatgtagaaattaacatagtttaaagaattgtaaaatggtacagaaaaattctcagggtacaatcttaggcgaaaagagtaggacataaatctgtatatactaaaacatgtagttatataatatcaattacaattatgttaagctaatacaccctggaaaaatatatgcagaaatagtttataatggctaactctggttgggggaatatgtgattattattttatttgtctgtcagttttcctgattttctccggagagttttgacttaaaaacaccaaaaagtagatttagttgaagtgttggatgcaaatctctgtcccctgtattatgtctttattctttccaaatcaccaaatatttccaatacccatactggcaatttttcataactgtgtaaaatatggttttggtacaatctaaagatgtcacagcttttcttgtggctaacaggacagagccaaaagttaagctgttgctgaaaatgaaggttgttcataactggaatatgcaggaactctgtctcctaagcttcttaggggagttggattagagtatccagtgacctggtgctgaaatgacaacagaatgtgccatggaagagcatcacagttgctgggagatattattacactgcaatcagcatgtgttacattgtcatagggagatcagcacatgttacattgttataatgagattaatatgtgttatattgttacactaagcttatcatgtgttacattgttttacggaaattaacatatatgtttactgatttcagtattttgaagtttttaaaaaagagtttcaagtgcaccacccacaatttcagagtcagaaagtgtgcttacaaaagtcagttgagaaccattatcttacaccatgatgctgacgttcaaatactttggaaagggtggggtgagggacatgtggctttttgtttcgtttccctaaagtctcttgatgaaccagtaacttgagccaatgaaaggctgaacacattctccctgattcagaaatgatctttaaagatggtctaggaagacaccagggaaacagctttgaaagagaaagaagggataaaaacaaccctcccatctgacaatcagtctcccggctctgttcttcttccctccctcctttaagtccagttaaagtgcagcctgttggaagggattagagcgaacgtggtatttccacttgacattaaaatcatgagtgaagacattaactcagacgaacagcagactgaaggctactgatgtcagctagggatgactgtcaaaatcctaatgctcccaggaaacccctctggggactctggagccatggggtcacccatccactcagcagccattcacccagcacccagtgcccttccccacagggctgggacctctggtgaaataataatgggaaccttttgttctggttaggattttaagaagcagctttataaaggtgtagttttcattcagtctaatgtacccatttgaattgcacagtcttgtatgttttgacaaatgtatataccttataaccacaactacaattaggatattgaacatttccatcacttcccagaattatcttgtgtctcttcccccaactccaggcaacctccgatctgctttccagcacaaggattcgatttatcatttcatattgcttattgcagtgtttttgagattcatccttcttgtagtacatatcaacagttcttttgtattgctgatcagtattccattgcatggatataccaaaatttgtttctccattcacctgttgacccaatagctgtttccaattttcagctctgagaaataaaaccattatgattattgagtcttcatgtagacttgtgcattgatttctcttgggtaaatatgtataagtggaatgactgagttggatgggtaaaacctttataagaaactgctaaaatgttatctgaaggggttgtgccattttatgttcccaccagcagtggatgagccttcctgttactccacatccttggcaacacgtggtattatatcaaccatttaaatttttgtcaccattttggtgaacaatggtatctcactgttggttttagttttaatttccctggtgacagtaacaatgttgaagatcttttcatgtgatttttgatgttttggaactcttctttggtaaagcatgtgttcatatattttgctcattttcaagtgggcagttggtcttatttttgagttttaagagttctttatgtattctgaattcacgtcccctctcaaatgtgttttataggtatgttctccatgtctgtgacttacctttttatctccttaacaataccttttaaatagtcacagtttttaattttgatgaaatccaatgtatcatttgaaaaatggtttgtgattctgtatctttcctatcctaatgttgcaaaactttctcctttgcttctagaagttttagagtttagcttttatgtctagatacgtggtccattttgagttaattttttgtatggtataataagggttgccattcacatttttccatgtggatatctactttttatgacactacttgttgaaaagactatcctttcctcattgaattacttcagcaactttttgttttctggattccattctgttccattgatctgtggggctgcccttatgccaatctcatgctgtctttattcccatgtttgaacattgttacaatccttgctatgtaccaggaatggttccggctgctttatatatattaataacttaactctgattacattttcttggggtaggtgctgttatcatccactattatatccagaacttgaggctcagagaggtttagcaacctggctaaggttgcacagtgagtcagaattcaagtctaggcactccggctccagagtcttgctcttaacctttgtgttctacttcctctccccagtgtttctgaggcaaatacacattcacatttatcaaaagaatatgcacatgctcccaaagtttttctcccttcatttgtgtgagctgcctgaggtcactgagagcctccaacagcactggcactggggcacagagaagacagagccaggagtctctgcccttggggagctttatgggctgaattgcattctctcaaaaaaggaaatattggaatcctaatctcctattccctagaatgtgaccttgtttgggaatggggtctttatttttaggtgattcagttaaaaaaatgtgaccttgtttgggaatagggtctttatttttaggtgattcagttaaaatgacatcatttggatgggcctcaatccatgatgactggtgtccttgagccaatggaaaagggaaagtgtggacacggagacagacacgcacacaggcctgtaatcccagcactttgggaggccaaaatgggtggattacttgaggtcaggagttcgagaccagcctggccaacatgatgaaaccctgtctctactaaaaaaaatacaaaaagtagccaggtgtggtggtgcatgcctgtaatcgcagctacacgggaggctgaggcaggagggaggttgaatcgctggaactgggatgcaaaggttgcagtgagctgagattgtgctactgcattccagcctgggtgacagagtgagacattccacctcagaaaaaccaaaaacaaaaaaagacatacacagacagaatgtcatctgaagatgaggcaggggttgggatgatgcttctgccaactaagaaacacccaagatcacctgtaagttcctggaagctgggagagaggcacgggacattctccctcacagccctcaggagaagtgagcactgctgatgctttgctctcaggcttctggccttgagaactgtgatacaataaattcctgttgtttaagccacgtagtttgtggcacattgttttggcagcctgggcaaaccaacacaaggagctaacacctgatggagggcagggcttgtaatgttgcctgctaaatgattgaatgtatgtaaaaaaaagaaggaaggtagtctccaaatatgtacaactattatatgacaataaacaacattttaaaaaggaagagctggagggcaagaaaatatcgcctaaaatttaatttatttcaaatttatctcaattaaagcgtccaaatttgatgtaatgtgctttcatattatttcacatacattactttatatacactttatttattgctcattgtctatattgtattcaatgtgtatatctctctatataaactgcatgcggtactccgtgcatggcaggagttcctgactttctcagggactacagcgtcctacatgagttcttccctgtgccagggtgagccttttggtcgtagaagatgccccattctctgtgtccaactccaggccggggcctttttaaattcttctgatttacataatccccatccttgcctggcttgatgcttctgggtctgtgggccgtgtggactgattgtgcgcaggggccctagaagcctaccaggaggaagccctgttggttgggctctgcctccctcaggacgtcctgtctgactgctccctgcagggatcccagccaaaggcaagagctccctctttagtcagctggtgtgatttcctcaacaggctttactagagccgtactccgttgagcaaccattaatggtattgaatgcatgacaactactatggccatttctttaaacatgatgcatgacacacactctctctctccctccctccccctctctctctctctttctctctttcaaatttacattttaaagcaactctatgaggtttcccctaataactcagccaaagcggtgcagacaactgagactctttcagagagaaatgtaaatgctggggcaagatgtggcccagatgagggccaccccgcaggcatcccaaacagctgtttcctaatcctgacatgttggaatggaggagtacctgaggaacccttggcacatgagcaattggtgactttctagtcagaagttggattattgtcaaagttttagctgcaaaaggatgggagaaaggagcagagaatggtgtgattatcactgacgcagctccctctgcagagaacagaaggccaaggtacattacatgaaaagcaatttcacattccagtattacttttagctgctggtaatcctgttttaaacatgcaaaggctaatctttactttcacagatctctctaaaaagaagccaagaccttggaaagctgtggttattgcaagttagtgaaattttaaaatttatgttcagaggacagagtgccagaaacaattttctgcttgggacaggctctctctaagttaaaaacggaatataattcaatgaaacaaacttttttgggaatttctgcttaaaagatgaatgtgcataaaaggtatcggtgtatctgtttgggccaaaggtgtgagaaatgagagttgtgttttaaataatgatcatcccagggtggcccatgatctctaagtataacaaattaaaatgtcttgagatatttcagccaaagtgcaaaacagacatgggttttccttccatcccatgccaactgggatggaaggaaaggctggcagcagacaggcttttccaagttctccagtcctgtggacgtctcctccacttgggtcactttacaagcttggcttgaggccgtagcttctgcagtttctaagtgaagcactccccctcatgctcttactcttctcaaaaaaggcaaaatgtggttctcaacaggtttgtgaggatacattcatattgttcttggaaatttgggcaagtagaaaaaaaaatagctcttcaaggagcagagaaagagacactggatgtccagatgacttaggagtcagggcttccatagcaggagcatcgagttggcagagggcagtgggcagtgggaacagccgccacttagaactgacacaaggggatggtaaatgctgtctccaccctgcatcccatgagccacatccgcactttcctttggtgagtgaagctggtggggccggacacaggggagccaaaggatgttatcagagggatggggagtaaatcaggaaaatttggtgggaagtaaagactcaggagcacatcccaagagtcagagggtgagctgcaggaacggacttgtgggtatgtccttggccaaactcaaaaatagagctacttacttaaaagatattattcagagcttggggtgggtgggagtggaaactgcaggggaatgtgcttccagggcaaaaccccaccttttctgcttggggatgctggggcactgactctgtttcttcccttcctcatccccacccagtcctcaccccatgaggataacctgtcataaccagaagtattagttcattctcatgctgctataaagaactgccgaagactgggtagtttacaaaggaaagaggtttaattgacaaagttccacagggcgggggaggcctcaggaaacttacaatcatggtggaaggggaagcaaactcatccttcttcatgtggtggcaggaaggagaatgagtgtccagtgaagggggaagtcccttataaaaccatcagctctcatgagaactcactcactatcatgagaacagcatgagggtaactgctcctatgattcaattacctcccaccggtccctcccatgacacatggggattgtgggaactataattcaaggtgagatttgggtggggacacagagccaaaccatatcaacgagagtccacatttctctgcctgcttcctgctcaggcaatggtaacactaatgcttttgatctaagctctgaacatgaaaagccatttagcctgagttttaacttctcagatctggggatgccacccagctcagactgagctcaggcccccaggggtttgggttgggagccaaggggaaaatctagctttgtttctgcttgctacaaccctcatttctcctaaggtcctgtaacatttgttaaataaactggggacttgatctagtattttagtggaggaagggtgtagtttcttctagtctgtgacctatagaaatgccatagaatcattatttatcaatgaaaaaggaatgtctgtcaagggaaattaattgaactcagtcctttcgaggccagttctagagcacatgtcagtgtgatgattcacagggaaaaccggcctctctccaagccttgtgacaacgctgtttctacccttgtcaccctctgccattatctattttgtctacagcagtcagagggatttaaagcatgacctggcactctccttttaacacccctgtccactaaaagccttatagacagcaaagaaaacaatcaacagagtgaagagaaaacctacaaaatgggagaaaagatttgcaaaccatatttgaatcccctcaagccccatgcccccccaccagccccttggcccctcaagcggcagccacatccttgcccctgccttgggctgctgcagacatccctgtcacctctcagattcttgctgtctgtcctagagggagacccattggctcaaatcaacaagctccctgccctctgacctctaggcggcttcagcagaaatcagaaatcagaggtcagaaatcagaaggcaaaagaaagagaatgaggccaggggttggtttcttggttcactttctacagagacattttgcctggctttgtccctctatcaaaggttgcagctcctgataggtggcgtacccaccctacatgccctcggctgccctgaattaatctgccttcgagctgctcaggttcactgtgtccctctttcccaaaggtttttctttcagcagcttcttttgcctgacatgctcttcccagacagctgggctcacctggagcctgaccacaatatttaaaatggcaactgcccccgtctctccattcccctttctctgctctactgttttctcataacatccttcaccttctaaaacactgtgtggggtactcccttgttacactgtctgtgaccccatgaggagctctccttctccacagcagagacctttgtctgttttgtccactggcacagagcaggggcccaagtgagcacttgctgagtgctggaggaagaagcatcctggccttgggctcgtcttctagtctttgagaggtagcagggcagcttcggcattttccatgtctgcttctcttcaggaatattaataacaagagtaactgcgtgagtttcccagggctgccgtgataaggtcccacagacagagcggcttcagcaatagaaacgtgttgtctcacagttctggaggctggaagtccaagatcaaagtgtctgcagggccctgcctctggaggcgccagggaagggtctgttgcagggccctctcctggcttctagtgtgttttggctttcagcagcacaattctaatttttagagggcgttctgcctgtgtgtatgcctgcatctaaattttcccttttcataaggacagtcgtattggattaggggcccaccctattccagtataaccgtatcttaccttaactaattacaactgcaatgatcctatttccaattcaagtcacattccgaggtactagggacttcaacacatgcattttgaggaggtgcaattcaacccataacaatagtgaacatttattgagtatgttctctatgccaagcactgtgaattacagtatgattcccatgacaatacctgctgaggcttagatctgttattattgccactttcactaagagaaaaatgggtatcagagaggttaagtgactagctcaaggtcacccagctagcagctgcggggccagtatgaaacagagcccagatgatctatcaccctgctttctcccttttaccacgttctgctctcacacgggctggatccagtgtcctgagttccagcagtaaactctgaggcctttgattctgaaattgtcgaatttattgggaagcaatggagactacaggcaacagaaaccataaggattttttttttttttactacaagtcaagagcatattccattcttgctaattatgaaaatgtactgcagtgaatcagaatgacttcctgtgaattctgacccctgatttgtaaaagcacagagtctgtgcttctcaagagtgagccctcaccccacaaagctcctgccccacatggcctgaatgacgctcactggaagttcactcatcagagagttaacactgtgccaggcaaatcaatttggaaaaccagctgtttctgaaagatggcgattatttacagttccccaagctgatgactgacgccctgagccaaaattaattgcagatcaaatgagcaaagatgtctttcccctctcaactttattagcctcctgagccattttaatagactgtcaaaatctcataagaggaatgaaaaaaattggaaagtctttttggataagcaatcacttcaaagggctggatgaaatatatagacatatatttgtgtgtttattacatatgtaactgtatatatataaatatatttattgccttcttttcaaatatatttcaagatatataatatattttgtatattatataaatatataaaatatattttatatattataaattttatatatttatatattttatatcaataaatatataaaatatatctacatattttatttccttgttttcaaatacataatatataaacattataatatattatgcatattatatatataacctatataaatatgatatttttatatatacataactttggaaagtgcaaggaacttaccttatattgatgctctgtgaggaacaggggagtggctttcacacactttggattttgtttccataattctgtcagatgctgtattagtttcctattgctgctgtagcgagttaccacagactcagtggcttaaaacaacccaggtggattatcttatagttttggaaatcagaagtctagaatagatcttgcagtgcaaacacgatggtgtctgcagggctggttccttctggaggctccagggcagaatcttgcctgctgcagcttctagagaacatctgcattcctgggcgtgtgaccccttcctcaccttcaaagctggcaatggcgtcactcctgcctctgcttccaccatcacatctccttctctgactctgaccctcctgcctccccctttcacttacaaggaccctgtgataatattgggctcacctgggtaatccagggttagctccctatctcaagattagtcccacctgcaacattcctttgtgccatgtaaggtaatatattcccagcttctgggaatcatggtgtggacatcttggggagccattgttttgcctaccacaggtgggaatggttatgtccattttacagatgagcaaataaattcagatgtgttgggcaatgttcccaagaccacttagctggtaaatgggtgatcaggatttgaattcagagtagcctcatcctaaagccaaagctgtttctccccagaacatttttctattccacactctcaacctcatgctgaatttagtttcatgcctttccaggaattggggtcaatgctaccattttaaggactgtttccaatggactattctgcatccatccttgcatctccagctctttgagaagatgaaagggggacagactacccaatgcacttcacttcacctaacttctgctggcccttcagctctcaggttcctggtccctgtctccaggaatccctcccagaaccccttatttgagagggaagctcgtctcagtgttgcatgtggtaattgtttccaggtttgcttttctctctagatcacggcaacgtcacctgtgacagctggcacagtatgagtgcaccttaggtgtctgtggaatggatgaatgcatgcctgcatgaaagaatccaccacccaagctctgaatcatcacttcctgctcagaggaacctcccacacagagattcctgcacctctagaacagcaaaacatcatttatccttgggtcatagtcaacctcctccattggactgtgagctcctacaggcaggcaccatggcaaaggccctctgtaagcccagcacagggccaacagcctgaccatgggaggagctggcaagagcttgctaaatggcggggtaccaactggccatggtccagatgactgagatccactgggtccaaacttaaaggcagtggcaggagtgctctccagaggctgagactctgagttctgattttagaaaggactcttccttcccttccaggactgtgaagtcatttaccctcctttctggggtttccaaggaatactttgcccaaaattgtcagcttttaaggaagatgatctgcctgccagagcatcgggatgagaaggagtggcttctggagtctggaatgaataagaatggcttcccgtgaagtcttcttgcaccaagggaagaagtgtagccacttcctcagtgtgcccctctttcaaacaatggcagtcattggactttcaggcatgatgtgagcattcatgaggtcccatgtagaacactttggggtgtcggtggcagggacagtaggggccccatgatgttctctttccccactctcttgggttctgagccagctgactgtgtgacccagagtaagtcactccttttggtcttagtttcctcaactgtcaaaagatagcaagaccccctgtaaaatcctgctctccacaaggatgtccatcgtagccttatgtaaaatcacacattatggaaatctacctaaataggacaagaatagttaccacttactgggtgtataccatttgccagccactgctggaatcacttaatgtatattcattggtacaatcctcagcccatccctatgaagcagggatgatggcttttagaagtggggaaactgagtcacagagatgctgaataacttacttgggggtcacgcggctaataaaaagacacagagctgggactggaacccagaaagcatggcactgccatcaggttccgagcagagacattcaacaacctcacccgcagacaatggttaaggaaattatcatacagaaaattactggagaaggataaatcgttcagcactagtgttaattcagggaaggtgatgatctacatgattttctgcatatatgatacacttcaacaaaaaaataataaataagaaaatggagagtcattctgacataagattatgtgaacaaaagcagatcagagctcgtatttagaataggattactgtgctactatgtaagaaatatacatctatgcatagaaagacaagggaagaatttgccaaacttccttgggtagtatgattgtaggtaatttcttctttgttcctctctatttttccgaattttacaaatttgccctaatgagctggtattgatttcttcacaacaccaataaaatactttacaaaaaacaaaaaacatctcccgtacttcccccataagtttcatctcagactgtgtttttccattgctcaaagtaaaaataaataaacaaaactgggtgcagtctataacttgagaataacaagaatgaatcttgtgaaacttccagaatgtgaaacgttgaaatgttttcttctaataaaaagaccacaaagtggaaagggaaagagacaaaacatcattcctctacattttttatggtatctattttttaaaagcatcttgttagaatgacccattaagtgcaaggtacaaaatgaaatgttctgtcaacaagaagtcagaaagacaattgcaagcctctgcctgtttgcatgggcatcaatcttgtcagtgcaaatcagtgagcaagagtgaaaataaatgaactactccatcaaggtcagagaatataactctctaattttagccctctctttccatttggaagggagcctaactgtgtgctgtgtgcccaaaatgtgaggcacagacatagctacaaaaaagaagagacacaagcatttcataaagaggacaactgaagctcagagatgttgagtgcactgctcagtgctacacagccaagaagtgccggagccaggattcaaatccagtttgatctgattccaagatctggaaatttctactaggttctgaagccacccaactttcccctccaccagatgtttgttttgcatattggaggttgagaaacagtgaggagctctatgccttcttttgaacatattggcttattattaaggtcttcctctctattatactggtcaactgaatgtcctttctcctttgccttgcaaactcccacatgtctggggtaatgagatgactgctaatggttttgaaacattttaaatgtcatggtaagagattggagattcaagccaattctctgatccgaactcctggggacaatatggccctgtttcacagggcattcatatttcatcatttgtgactaggtgagaattcaaaggatggagttatttattaaaaggaagatgacagggaagcaaaatctaggaaggaaatattctctagatgggtaaaatgtcagtgaagaatattctctagatgggtaaaatgtcagtgaagagctgcatgatgacctcctaaaatccagccccctttggcatgataaaggacatgctcctctaaagagatgcctgtttgttgccttaggttcccacattgcagtgttgcctgccccggaggtgtcaggaactgggtgagaattgtcgctcttcagtacccactttgaggttttgggtcaatagcccagacacaaatgatgtctgggttctccccatcccagctatttctttaaaaccaagagtttgctgaatgataggaaaccacattgtcctaattgatgaattctgatggggaaagcctgtgccttaaaggaccttatgaacattcccactgtgctgtgtaaccccctgtggcattctcaggagtaaccctcagttgacttacagagaagacggcagccaaagtctcgatgccccctgtactcaaggtgacgtatgggatctttgccggagggatcccagcttttccaaagatgctgttggtatagaaccaaatctgtaattcaggaaagaatgagcagagagaatggtcagtggaaggacttaatctattttctaaatcaaatttgggtatcaggtggtctctggattaaactcagagtcccaaggtggagaggcgtggatgctcatttttcattttcatcccaccttctccctttcttcattactttttttccttattttattattttattttttatttatatatatattttattatactttaagttctagggtacatgtgcacaatgtgcaggttagttacatatgtatacatgtgccatgttggtgtgctgcacccattaactcgtcatttacattaggtatatctcctaatgctatccctccccactacccccaccccacaacaggccctggtgtgtgatgttctcctgcattactgggaatgtccagctaaaagactacacttcccagttttcttgcagccaagtgtggcagcgagatagaaacagtaatgttggtggggcttccaggaagtttcctttttttaaaaggaacttttcatcaaggaggtctgcttccatttttgtttgtccttccttctttctgtgtcaggatggtggaggtgatggctggagcctcagcagccttttttggattactaggtgacttcagaacagcactgccattaacctccatcgtaactttatgagaaccagaaaaggtccccactacacaaaacgctttactgtcatccactgaaaaattgccatagtaaatccacaatgcatacaaggtgaaagatgttccccagagttgggtaatgcacaacctgtttaactatacatagagcccctgccttgggataaaagccacttgtttagatgctggaccaggaagttagaaagagttagcctgtgcccttactgactacactggttctgtaatttattatccaaacatgaggacttttgagagtgttgataattatgctaggatgacacacttacattgagtgtgtcctgggaaaaccaggatgtgtggtcttggagttgctataccagccctcgcaacttatttcatgtgagactgaaaaccttccatcttgttgaggtctctgttggggtacctgccacatgaggttagacctaaatcctaattgatgcccatggcatcagacaagaactgattaggagtttggagacctggctccatcttgaactagctgtgtgacctcaggcaattcaccctgccatgaggagattcctactcctccccagtcaaatgaacatgaccatgcttattttgcctgtcccatgaggtgtcaggaactgggtgagaattgtcactcttcagtattcactttgaggattttagcctggacacaaatgatgtctgggttctccccatcccagccatttctttaaaaccaagagtttgctgaatgatagaaaaccacattgtcctaactgatgaattctgatggggacaccccctgcattaaaggaccttatgaacatttatgaacagtttgatacttattcagcagaagtgttagagcacattgctcataacctgtcaggtccaacgttagctggccacactctcgcattttgctctttgtttctggatgaagctcttgtttctatagatctgttttattgccagatgtttttagcaaaaattattcatgcattggggggaagatataggacctacttatatctacagatggttaaattttgtgaagaaagtaaacctccataaagttatgggcataccaagagatgccagtgaaaactacgacacccatttcttcgagcttgcaggcatggatacatccatctattggcaaaaacaggttttaatattcgtgtaaaacaagaaccttcatgttctgcacctgtttctcacttgagtgaacgttagactccatcgttagcctgaacctttgctgtcacatccatggtgtacagaggtagtgcctaataaatccactaattcctattgttctcagggctgtgacagaagctgacattataacattatcctgaaaactctatgtccattgaatatgtttatacaattgcttcccctttagaaggtaactatgatccccagtgcaccgtcagggttggattccagaagtgtaacagcctttcttaatcatcagccaaattcactgattttcaatggccaacgttctctagggaccctcttaatgccctcaggctgccaggctgtcacccatgtgaaggtgtctgacatttgtgttattcacagccgtggttctgatccccatggcctgaccagctcatggtcctgaggctcccagccctaggtcccacttaatgtgaatcctcttatgatgtggccagcacctccttctggctcctctcacccctcacaaccccgtcttccctggtttcaattctccccatagagacactgctatagatgtcccttagtaggttagtgaagagagtcattgtacataaaattctaagttcagtgagggacagttataacttttgcagggaaattgatgaagctggaaaccatcattctcagcaaactaacataagaacagaaaaccaaacaccacatgttctcactcataagtggaagttgaacaatgagaatacatggaaacagagaggggaacatcatacaccagggcctgttggggtgtgggggggctagaggagggatggcattaggagaaatatccaatgcagatgacaggttgatgggtgcagcaaaccatcatggcacgtgtatacctatgtaacaaacctgcacattctccacaggtatcccagaacttaaagtataataataataataataaagcaataaaagccatatttagtcttatattcattcatgcaccaaaaggcagaaatcagtccacagatcctctcccgctgcccaggggctacaggggtcctgccgggctggccctgtctgccccggggcagacctgtacatcacacacactgccagtcttaatctgtttgtgacacgaagccactgccctccccctacatcagctgatagagtgggaaggtgactgccttcagctttacctctgctcacactgaagcttatttgattggacagtttgagttcactgtaaaataagaaagcactcaggaaacttaagagtgcatcctgccccggagccccgccagcccccacggtgtgtgctttgtgttgaccttgttcaccacacaactctgttctcgcaggttgcccctagcctccccgtgcagcgtggcaggagcagcagttctggaggcatagagtggggattctagccccagcactgtctctcatgacctgcgtgaccgcaggcaagcgattttgcatctcggaatctctgttctccaaagaaaggtaataatacttcgtctttcagggttcttgtaaaaattttaatgatgataaaagaaatcatccaggacagcacctgttataattggcatataacaaattgtaggtatcattctagaaggttctgtctctccatggagatgtgattgcttcttggttaagaagagcatctggaaccaacccaaatgtccaacaatgatagactggatgaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccgcatattctcactcataggtgggaattgaacaataagaacacatggacacaggaaggggaatatcacacaccagtgactgttctggggtggggggagcggggagggagagcattaggagatatacctaatgttaaatgacaagttaatgggtgcagcacaccaacatggcacatgtatacatatgtaacaaacctgcacgttgtgcacatgtaccctaaaacttaaagtataataataataaaaaaaaaagaaaagaagagcatctgacagtggcacatatgccatgctaggaatgcacctctgggtctcttttcagcctccttcttgtgggatggggctttgaagaactgtgcagctggcaggtgtgggggtaagggcagcaggaaagaatttgggtcttctcaagtccctgcccttaatgccctgaagctctcattcttaactcacgtcatagtgttttagagacaaagtgtaacatacataatcatttttgccccctccacagttgggcatgcctaaggatgcccaacatgtctaagaaagcagcatgtctaaggatcagtcaagggtccataagagtaaacatcccatttacttttgcctagaacaaggtgatactgacaaagagtatgggtttaatttatgctttctggatgtggtgagcagaacaacagccccccgctctcaaaatgttcacatgctaatcctgggaaccccagaacatcttactttacatggccaaagggactttgcagatatgttaagttcagaatcttgacatggggaagttatcctggattatctgggtgagctgtaaatgtaatcaccagggtccttaaagagggagtcaggaggatcagattcagagagaagacgtaaggatggaagcagaggtcagagaggaagaaatatttgaaaatgccatgctgctgacttgcagatgcagaaaggggccacaagccgagagatgcaggtgccatctagaagttgggaatgtcaaggaagtggatgatccctctggagtctccagaaggaatgtggccttgccaacaccttgattttaggacttctggcctccagaattgtaagataataaattggtgtggttttaagccaccatgtgggtggggctccttcaacaaaataatagctaagctattgcagtaatttgctacagaagcaatagaaaactaatatatactggataaagatataattaatatattttatgcatttcctgtgtgtttgtgtgtgtgtgtgtgtgtgtgtgtgtgagagagagagagagagagagagagacagagagagagagaaacagatagagagagataaagagagaaacagagagagttgtaaacacagaggtggccgccacagacaaatggtgatgtataggatctatcttgaagtacagaagacagagaagaccttgcccatttattaaacactgtgttccaggaactgtgccgatgcctcacctactgtttccagggacctcctttcccttctatttcctgtttccatttggggagcatccactagggaacatacctccctctcaacccaagggacagggaggtagggagtgccctcttgcatcccctgggctctttctgtatctgcctcctgcaggaagctggagatgtgtctgctgcctccacccaaggaggggcttgccctgtagaggggtctggggttgctccttctgcctgtggctgggtctagcatcttaaagctagaggtgctgaactaactgccacttatgaagccatgctgtctaatccagctccactcaaaatagagctaacattttcatccccatctggttcttgtgcctctctctgtctccccctctctaaccttttctgaatttcagagaagaagggggcttatctattgtaaatccccaaacctatcccctacatgacgtaactgcattcccagcacagcccagtgagggagctatcactgctccatttaacagatgtgaaactgaggctcagccaggtaagggtgacccagctatgagtggcagagctgagatcgagccctgatcatcccaaacatttctactgtcctctgctacctctgggtgagaaggaatctgttttccttccagagatgctaggggagggtgctaagtcctatggagcagggcaagtggaattacccgagaggtgagaggaaatgggagcaccagggatgaatcactaccggcagctgccaagcaaagcaagaccctctccaccaagggcaggctgtgtgcttcacggcaatgtatggaagcccactctctctcagcagagctgcttcatccacagccccaagcaaatgtcagctcccattctcatcagactttgcttcagcttggcagtggaggcagaggaatgagctgactctcccacatctctcactgggaccagttgcaccccgactacagctgcgcaccttacgcttcacaaaacaggacctgtgggtcactcactggccttgaagggttagctgggcttgaagctctggtccctggtggttgaatctccaaggcagggcaattgaccatctaacgtcccctctctgtgagctcctattcttgggagggacgggagtctgtgggctggacagaagggatttgaccccagcaattgctatggtggtgagaacgtgaatgcagatttcaaccaccccggccttgctttatatccttagagcacatgtgagcatgaaactggacagcatatctagatgcccaacagccggtccatgctcagtaaaaggctgcttccttctctgacctccactgtctttctttataaaaatccagaagcatacaaagtaaggactcaaattttaagagtggccagaaaatgcttgcttttaaaagcttttctaagagtgttggatcacccagtcttgcttctcatcttacggataaaaatctaacctcacactgacctagccattagcccaatgaatgataccacctttctggcctggtcttctttgaactctgacatgagtgattgaggctcagaggggtgaagtgtctcacccaggactacacagctgggaagtcagaggatgtgggctggaaccatagcctccctggtggtctcagtgtggggctccttcaacaaaataatagctaagattatggagcaccacctatgtgaatgaccccatgctgaacttatttatttgagacggagtttcgctcttgttgcccaggctggagtgcaatggtgcgatctcagctcattgcaacctctgcctcctgggttcaagtgattctcctgcctcagcctcctgagtatctgggattacaggcatgtgccaccacgtccagctaattttctatttttagtagagacttgtttctccatgttggtcaggctgatcttgaactcccgacctcaagtgatctgcccaccccaggctcccaaagtgctgggattacaggtgtgagccaccatgcccagctgctgaactttaaatgcatcctttcatctatcttcaccaccactctacagctggggaaactgaggcacggaggagtcatgacaacttgtccaagatcccataactcaaaagttcaatgttgcaagctgcatgcaggcagatgaccccaagcctggcactcttgaccacagttcagggtggccatatggagggtctcttctcagctttctccctgttcatcaggacatagcaaactgctgcagtgagatggtctccacttttatgattacagagcattttagattcttccaacttgatctaggaagtgatttcaggagaatcttttcaaaaccaaagttattaataactgcttctgaaattataatttgagactttgtacaaaacttgatttgggctccagaactcctaatgatggttcaacaaatcagatggaccttcatgtggttccaggccaaaagagggggaaagtaccacagttttctgtaaacacatctaaagttttcatgtctccttccccttgttcctcccagtcacctcccttccctcccttctactcaactgtttagagaaagcgtaagaaatctgggactctcttaggcactaaggtgacagcagacaacacaggtcctcgtctaccctagaagacctcttagtctagcaaggaagggaggagtacacaacgatttcccaactaagtggttagaggaacacaccaggaaccctgtaatgcatgggtatcccaccaagtgcaaagacccaggcagcagtccaccgccggtgagcacccagaaccaatgtcaccaggcccatatggctcattcacagctggcactctgatcctctttgctcttcttttacatctatttctaacacacttgggtgtcttgtttcccaaccaagactgcatatcaggaagcagcagattttgaaactgcatggcattgagagaggagaaaacaatgctagaaacagtcgtgctgatgacagcaaggttgggaggagattcatgcaagctgagcagctgccacctgtgagatattttacataattccacagattcctcacagcagttgtgcaaactgagtattatcatccccatttttcaggatgggagactgaagcccagggaagtgactatgattggcttctgtgtttaagaaagaaggaatcccaaggaaggaagggtcatcccaagtagataagagaaccaccatgaccctgggcattctggaagataagggaaggttcaagaaaatgaaggcttccccacactgggcttgacaattggtattgatccaattttcagcccaagaactccctatctcctgccctcacctccttttctcccccagacactcaggtgcccaccatgtggcatgggctgctctggtgctggaggcacagggttgataagatgcagcctccatctcccaggatggagacccactaatagctctctccaggtgaggggagcacagtggaggggcaggaactgctgtggccaccccagcaatggggacggggatgggcctaaagccaggagcctctttcacactggcaacagactgacactcacactgaagcctggttttcatgctgaggacaaactgctcgaaaggaaggcagctgcctaaaataagtcactttaagcgacaggtctaattttagagaatggaatttgaaagcctattgtgtaaggcagagggaaaaaaaaatccaacaccaaaaaggaatttagaaataaataaataaatgttggttatcccaacttttgaataatttcttttttcctttttttttttttttttttttttttgtgatggagtcttgctctgtgtcccaggctggggtgtagtggtgcgatcttggctcactgtagcctccgcctcccaggttccagtgattctcctgcctcagcctccagagtagctgggactacaggtgcctgccaccatgcctggctaatttttatatttagtagagatggggtttcaccatgttggccaggatggtctcaaactcctgacctcaggtgatccgcctgcctcagcctcccaaagtgctgggattacaggcacaagacactgcacccagcaaaattttgagtgacttctaaagtacgtgaaaaacattcatcagctccttagcataaatatactgagccatctgtgatgtttgcttgatacagaggttctcagccaggggcaattttgctcccatgggatgtttggcagtgtctggagccatttttggttgtcacagctggtggggcagatggtgctactggtacctaatgggaagaggccagggaggctgctgaatagcctaggcacacagcacagcccccatgacaatgaattttccagctcaaaatgtacacagatatgaggctgagaaatgcaagtttggtacaaagtgtctgggtgggctgtccagggagtgcacccaacaccagcaggtgtgactttgtctgtgcaggcaccacccctgggaccttgggcaatgcctgaccctctgtgagtcacacgtccttcatctagaaaatggggacaataccacttaccctgtggggctgtttggggcttgaataaaatgacaaacacagagatgcctggcagtatttacggatgtctccagtgacatgtcatgtcccccaaataatgtctgggataatgaagaagacaaagcaagtcttccaaggcagctgaagttttggatcccaggggtggtgcctgcacagaaaaagtcacacctgctagtgctggtagctctctttgtcccgtgaatttggatgacaaggcagcaggtacaggggagagctggaccacagtgtggctgtgatgctggcatttgccactaaacagcatgggtctctctgtatgtaacacggaagaagacttgtccccatggctgcctagggatggcctggggacacagcctgagtgacatgcatgggggtgctctgagggggaccttggggccagatagctagggctcaaatccttttactattcctcactgtttgaccttggaaaagtttctttatgtctttaggcctaacagtgcggcctaactcacagggcagccatggggacagctcctggcccactctgagtgctacatgcatgtgcacttgatgaggtttgcagcccagtaggtggaggccaagtgacggggagcagctggcctgggtttctcactgcaggtttgtgtcccactgagatgggaagccaggcctctgactcttggtccagagctctgctccaggtcaggtaaagcacgctcagctggaaatattatcccgacttaaagattgaagatcatcaacatgggagggcagaacactctgaggatggggcctcatgactgctggctttgggagcagctgagattttttttcaacaggtgcttagtcagtgcggcttgcaggtacaccatagaggaatttatgaagttatacgggggatgcaaatggaaaaatgatgtccctgtggagaattgaattctgtttagaactgatggttctcagtgtaaatgcctcattcactacaggttccatattcggtctttaaggcttcaggtgttagcttgaagaaacaattcacttcccctctctactctctgagaacaagcagcgcctccttcagactgtctggcaaaacctcggtctcgtcaacaggaagagacaacaggactctcccaggatcactcagttaatgtaggtacagccactgacccaggcgcctgctcaatctgctgactttaaccagaccaaggagaaaggtaaaagcaagaagcaaggtgatctcatttcatcccagtgtttccgaaaatagaaccaacagttgttgaaaggaggtggaacaacactgtggttgtagatttctatgctgctgtttttccttctctggacaggaatgactccccttcacatcaccttccctagacacccccaaacaccctccctgcccgccttggggggtgctggtctcacgcttatttagtataaatgcaagctgtcttactggggccctttggaagggtgctggcgggtgccccttctccctctctctgggttcagtcagtctcctcccaagtgacatgagtgacctcagaggcagtttggatgctttatgcaagaatctcctctacgctcccctgccaagtggttggccagcctatttgcacacttccatagatggggagatcaccacccctagaggcaacccactccatttgtcagaagcaacagtaacagtaaagatccagactctgcctccctaagtctccaactgggaattccacctttgagtgccctcaagggagaggagactgctgtgaacatccaagcatctggggaacctcatggagagacctcctcagacttccctgcctgcagcagctcaagccccagaacatttcttacttaaagccttgaggtttttttcaagccaaagttgtgagttgaagacagcccagtcaagagtacttttatgaaaatcatctgaatgtctctcacttctgacttcctaatatcaattttttaaagaaatataacttttagacatgtctaggaataattagtgatagcatttattataggatatctctgtggctagcagctgaactgaacactttgcatggattgtgtctttccatattatgtgatcccattttacagatgaggaaactgaggatcagtcaagttacatggttacctaacagcatagagtttgtggcaatgacagaactgagatttgaacctgggcgtctggggcccaagccctgaacctccccaccctctgatccctccagtcatgcaaggatgcccaccgggccccaggactcactgcattgaggccacagagctggtagcaggccatggtgacaatcacggtgaccacctgccagcggacgtagggagctctcagcagctccagcacggacaccaggcggatgctcctctgcacgcggctctcagccaggacctcctctacctcttgggaaacgtctgctttacccaagaacgtttggaaggctgcaaacagaggcacacatggactttcagcagggattagagtgtccatcatgtctaatgctgggccctgcagggacgggtcccacctcctagccacacaccttagctgggggcggaacttggcaggggcctttgaaactatggagtccaaagcccttgtttaaaaatgggaaaacagaggcccagagagatgccatgatttgctcaacatcacccagctggctgggagaaaagctgagaacgtgggtctcttgactgtccgcaacgcaaggcagagcacacccagagttcaaacccgtctataacattgggcagttgtgtccctgttcatcttttgttatcattcctgcctccaatggctgttgtaataattgcatgatatcatatacattcaaccatggctcggagcttcccacactggagttcgtttgctgaatattcactaagcacctcctgtttgcctggctcatgagttcatcctcattgcaggtgtccggagaccagtaggatgtcacttggccaggatgccctgcagtccatgctattgtgaaaagaaggattgagcttaacgactgcaaggccccttccatgtgatcctctgaaatacaagaaaacttgagtggaaatagtcccaaagagtgaatcttaccaggactcaaacccaccctcatgatttatgccttttccatgttgaacactgcaaacttccagcctcagagaacccatcattttttttttaaatgaagaccttaattgtgcaaacctctatgaatgtgtgcttgaaggcgggctgactgattagatcccggaaagcacaataatcagatcatggggtgcacttttggacacagatttcaatgctcagtgctctgatctttcttcctcccacagggaaaggtggctattgtgctggctcctgcggacagtccattccagacacagcaggcagcatccctaaaacatggctccgcccctcagggcgtgtgaaaatgctcttcttaagcaaatgccattaaacttgctccagattctccaagaagcaagaacccttccgaaggctttggagtgttatttccagcagggtactaaaaactgcttcagaatatctttttttatgaactataatttaatgctctccccagcatttattaagggtaaatgagaaaagcagctgaatgagcaatgtttctgtttcatgcattaagtataatatttctactgtttcctcaaagttcaaaatgcaacatctatgtgataaaataactctagacttctggggtagaaaactatttctttccttcatgacatacatattttccattataaaataaggataacttcataacctatgttttttttttctcttttcaccatggctgccaggaagctctcagacaaatgcaatgtttagcccttaacagaatttcctgaaacaaaaaatctctcttctttctcttaaaatttcctatcttccagctccatccatgtccctgcaaaggatatgatgtcattcctttttatggattcatagtattccatggtgtatatgtaccacattttctttatccagtctatcattgatgggcatttgggttgattccatgtcattgctactgtgaacagtgctcagcaaactaacgccggaacagaaaaccgaacaccacatgttctcacttataagtggcagctgaacaatgagaccacatggtcacagggaggggaacaacacacaccagagcccattggggggtggggtggggggagggagagcattagaaaaaatagctaatgcatgcagggcttaatacctaggtgatgggttgataggtgcagcaaaccactatggcgcatgttgacctatgtaacaaacctgcacatcctgcacatgtatcctggaactttaaaatttaaaaaaaaaattctgatcttttcttaaagcttcaatttaaccttcctattgtatatatgttcataaagtgggtgatactgtttcagagtgacccccagcctatgaatgagcaaggaggcagtccaagggcccagccatttctgtccagtgggggacctcctgcaatgcatgagtttctcctgagtttctccagagctctcccctggacttgccaagactttgccaggggcactgtggcctgatagctcctcctgcccagttcttctcccatccttgtcactttccatgtgttattctccattgaaacttctgctctcctaactcgttctcagacctgcttccaggagaacccaaacctgcaccaaggagttacctgccggcgcctcccacacccttcagcccctgcctcttcagtgccctgcaggaccctggcccaagcgcaccagccttctatttccctaactgccaggtaagtccgccccccacccctccatgactccctcactattttcaatcactcctaacaacggcctgttgggatttgggcttggagtcctccctattccacatgcaccctttctggctgagggctcacagatattcttttgaaaatagcaaacatagaagactgagctggagtcctgagggggcaccaaggagggggcatttcaggctgccagagaaggcaggggcactctgggcaggaggcagaaggatggaaagttgtctcctattcctggcactagggaaaagcaagagacattctgtaaggtacatggatgtgctttggtcaaggaataggccgaggcaaacatccaggccagaatgactcagtgagtttaggtgcacaggtgcatactccacttgttatataacctgtttgtgtaagttcatacttggcttggagccactattgtttgggaaggtataactgccctgctgacactgtacgggggctcttgggcatggctccacatgactcttgtgcagctgctggcacccagagaaagagaggagagggataaccagagccgtccattttgcagatggacagaggggagccagggcagggttcggcacagcacggcatggcacggctcacgcttgtgcccagagagagaaagagttaagctgctgaccctgaaggcaagggagagctggccgtgcagctgagcgtgggagcagctggctcaagcagctgagacagaacggacagtgtatgagagctgctgatgagagagctgctgagtaaaaccatattcacctgcttacggccccccgtctgttttttcagctacctgtccatccatccaccctccttgggcctcagttggggctggaacctgacacattcatctgcatatctggctctttcctcaatctggaatgttcttttgacctttctgcacctggctacttgcctcgttctttcagccttatctcagacacctccaggaagccttctctgatgctttcctggctggacgacaagggaggagcaagccgaggagggccttgagtgtttgcacggagatgaagttcctgcccacaggtcacagggggtggcaagacctatagttctgagacccctgaaggtgccaggcatggggcttgggagctgggcatatggtgattaaaaaaagaaaaacaacccagattgtcccatcctctggtccagcctcattatcttatgaccaacaaggaacaaagacagaacctggtgcttcaatttgctgacgtgttccttgtgtccctgtagccggcactgcatgccacccatgtctctcctgcacatggacagcttcctacacccagcacccgtgcctctccgcctgcggctttccctgggcacaggtgtgtgctcagccctcagcagttaacacccccaggagcagccctcggttaagacaaagctgatgttaacagaggtatacctagcttcctcacagacacctgagtgagtcctacgctgtcccccagaggtgactgggtgggtggggtcccagttgcccacagctgacacctgctcattattgaacctcaatgcctcctccacttccctgtgccatttcccagctggggaagtgatgcttcctcaattgtaccctctccttccctgtcccatttcccagctggagaagtggtgcttcctcaattgcatcctccatttccctgtcccatttcccagctgggcaagtggtgcttcctcgagtcacctctcaaataaacttcccatcttcaaaaccttgactcaggctttgggggcacctgacaacaatcacaaagtcacctaaactggatgcctgtggtcacataacccagacactgccttccgtgtctgatttgtctgatctagtgactaagccccttcagcgtctacagtccatgtgctcctctctgcctgagcccaggcctgccttagttcaggcctcagcctctccccactgggctcattatccccaggctaatccccaggaagatgattgggccactcttctgcacacaaatctgtgctgtcttgcccttgccagcaggatccagtccaaattctcatctgccatgcagagcctcctcccacggtccctgtggcatctggaggctccccccatctctcttggctgctgccctggaaaaggcactcgtcctccattccacatacccccatggccttgcctctgtgccctgctcgtgctgttccttgtgtccagaacaccctgccactttgttgcctgcctaggacatccttttccgaggatcccctcagcagttacatcttttggagaccttccctgcccccatgatggctaatcactgttaccctctcatccgggtcgctcttgcacctgtgtctgtctctcttgtgcactttcactcttgtctggggcgttctgtctgcacacctgctgtgcccacccctgggagcgccccctgaccaggggccatttaagggatgctgtgttactgtggaaaggggtgggccttggagtcggagcaacctgggcttcacacccagccctgtctctgctaaaagaccccagactagttacctattctgcccgccccatgcttgttcttccatgaaacagaaataataaaacctacctatgaggttgttttggggaataaaatcaatgtgtgttaagtgttggcacataatttgtgttcaataaacaattattgttattttatttcctctctgttgagccttgcatagaatgtacatccaacccatgtgttttgaatgaaatagtaaaaatcaagactcaggtgacagggaaggagaaggagcatgttataaacacagaagcgggggagggctgagcaaacaggaacagaggaaaattatgctagatgtcaaccaaattgcatcagcaggggggccagtatctgttcggtgttctccctactgttccgggcatggtgtgattttccaatggcaggctccccatggtcctcagacaccttcagagcacagcagagtgacagacactgatgcatctgggggtggcccacatacgactgcaagcagatgagatggagcccgccagcctcccttggggtcctcagagagccacgctgttagcacaggtgccatcctggcctggagacccctccaggtgtctgtacacctgctgagcccacacctgggagtgccccctgagcaagagccacttaagggacgttgtggtacagtgggagagggcaggtcttggagctggagaaacctgggcttcacattgtctcagggccaatgggtgctcactaatgcaaacacacattgtctcaggaccagtgggtgttcaccaatgcaaacacacattgtcttgggccaattggtgctcaccaatgcaaacacacattgtttcggggccaatgggtgctcacaaacaaatcctggctgcaccattttctatctagtatgataccaggtgaagtatttaatgtttccatgcctgagtttccttgtctgtaaaataaacataatagcattggtggtgtaaccagtgttcgatgttggcacacacaaagtcctcagaacggtatctggctcttgatgagcaaggagcattatgaatatacatgctatcactgtggggtacttgctacattctccctctccctttcatctttagcctggcagagggtacaaaatgctataaccttctgttgtgggttgaattgtgtcttcataaacatatgctgaagtcctaacccctggtagctgtgaatgtgaacttacttggaaataagacctttgtcaatataattaatatgtaagttatgaggaagtcatactgtaggaggatggactctggatccaatatgactcttgtccttacaagaggagaagagacacagatagatacacacagggaaggcaagcttgtgttcacggaggagaggttggagtgatgcagctgcaagccagggagcaccaaggactgctggtccccgtcggaagccagaagagggagcatggccctgctggcaccttgaccttggacttctggcctccagaactgtgagggaatccatttctgttgttcgatttttttttttttttttttacagagttccgttcttgttgcccagactgcagttcagtgatgcagtctccactcactgcaacctccgcctcccagattcaagtgattcttctgcctcagcctcccaagtagctgagattacaggcatccgccaccacgcctgtatttagtagagatggggtttcaccatgttggtcaggctggtctcgaactcctgacctcaggtgatccacccgcgttggcctcccaaagtgctgggattacaggcgtgagccaccacgcccaaccccatttctattgttgtaagccactaactcatggcactttgttatggcagcagccacactttgtcacctcttttatcacctcctgctagagcaaagcgcagaacaacccggaggcctcttccctcttgtgatcgggggcctgggatgagacaggcaaagggacttcacgtggagcatagggcaatagcctcgtataagttccatgcccagagtggcactgagcttgttctcccttacacagggcaggcctcatgcttctaaaaataggagatttcatcaaagcatttatttttcaatgactaatggaatttaagaggaggaagtcattgggtttttaacttaggttcagtgtgtttttattaccgacagcagttggatccaaggtagggtatgtaacaaggggtgtaggaggagatattggagctcctatttatagctttataacgttttattatggaccgaacctggagccttcacatggcctatgtgactggggatcagggctccaccgtgtggagaagctgacagggtgccttcgatctgtcttttgaatgacatattgctgtttacttgtgcaatttaccagttagcagatttggaaatggtagtatttggtttcaattgaattaaccccaatgaatatacaggtggcttgtaaagaatccccaaaagctgagcatagtagtacatgcctgtatgtagttccaactaatctttttgggaggctgaggtgggaggacctcttgagcccaggagttcgaggccagcctcagcaacacagtgagacctcatctcaagaaaaaaaacaaaacaaaagaaaccacaaattaaaggtaaaactaacaactcccacacaaagaaagacaggacaatcaatagtggaacccgctatctccatttcaggtgcaagcctgctgctagcctcaatgaccattgacagtacgctgcctcacagagattttcaaattcaagatgtagtcaatctgttgcttcaggataaagatgacattttaacaggagtgagaaagtagcaaccttttataagaaactgttccataaaaagagatgtgtctgtcatgtggtttggtagacaaagttatatacacagatcaccaataaaaactcttggatctcagctgggagcagtggctttcgcctgtaatcccagcactttgggaggccaaggcaggcagatcacccgaggtcaggagtttgagaccagcctggccaacgtggtgaaaccccatctctactaaaaatacaaaaaaattagctgggcgtggtggcgggtgcctgttgtcccagctactcgggaggctgaggcaggagaatcgcttgaacccgggaggtggaggttgcagtgagccgaaagtgcatcactgcactcccgcctgggtgacagagcaagactccttctcaaaagcaaacaaacaaacaaacaaacaaaaaactctcggatctgcacattcaaaaagaaaaacttgcaagcagtttaaaaaactttctgtttaaacatattccgaatgaaaagtttcagtaggttttgctaaatgattattgttaaaatataaaaaggcaacaacttcttactactcagcaaggacagtggttgatactaaggaagatggaaattcactggcctgcattttcaactcccaaaacatttcattcctgatggacgggattacaggttgaagccgcttcatcaagttcagccagccttgtcacctgcttctgtttggagctacatcgtttaatgaggttcatttttgagctatccacgttgcaataacattggtcaccacttgctaagggttcccttgtgttttatgtgcccttattcatttaattctcgtataactatcccctgaagtagacacagtcagtattcccactttgcaggtgagaagatgaagcttgcacatgggcagtgacactggatgccctcgcagcagagcctgagacacatgctgggtgtgggaagtttaccggctggagagcaaggcagtccaaggtgcatcttggggagacttctatgggcaaagggcatcagttctgcggggcttctgagcagcacatggaatacctccagaactgtcccacaggggaagatggggcatttatctgccagctcctgcccccaggggtattaactccctgaatgtctacactgcgctgcagatggctgagcagcttcctggccatggagagggcctgagcatttggagaggcacgtgctgtgcttaaggtgggcaaacattggcccatacctgagcccacatggactgtctgctgcagcaaggctgaaattagagtgggcagagggagggtgtgagggggacactagaaggggctagtgctgtcattcagcaggggagcggaggagcgagaattacaacccacaccggggctccagaagtatcattttcccaatgtccagcaatgcttcctggaagctcagccagctggggctgctataacatcatactacagatgggtggtttagacaacagacttcacagtcctggaggccagaagttcgagaccagggtgtccgcagagtcagctccctggtgaaagcctcttcctggctgcagacactgccttctcacttctctggaggcaccaccctcatgacctcagccagccctcccaaagactcccctccaaagaccatcactctggggagctggggcttccagatacaaattaggggtggtgaggagcacaaacattcagaccatgacagcaacttagaatcagacccttcagagctttggaatgctgtcctccccgcaaatcctgcctgtctctctcccctcccctctccttcctcccttccacctttcctcctctctctctcagtctcatctgaaattgaaagacactcatcatgctctctggttttcacccaaccttcccttcaccatcactttcatcagagcaagacggatatctgtgttgcaagtttagcaaatgccaggtcttcccctaaagacgggtggaaggaaatgtagctcctcacaggcccagggtgaaaaagagggtaggagggagagccagaaagtcctctctgtgcttccaacatgtcacagaattggtgctaaacttgcaattgcctgtagtgcagtgttgggggtgtgctgtgattggtacgtggccacacctgtgctggctcctgtcctcacagtcctgtcagctcggggcagcgcttgcactaggggaaggctcatggcagatgcttcatggaagaggttggttttcctctgggtctagaatgcagaggtgctcacagcatgctggatgaaggtaatgaacctactcatatttgcagatgtctagtctgcagaaaagagtttcccaagaggagatgcctggattggatttgctttccttggctctgaggtcagaacaagggctccaggcaagagctctgatgtgtgggaccacaaggaagaactgcctgatggatgtgtccaaggatgaacgtgttttttgcacagtgagttccccatccctgaaggtgtgcaagaggagccaggtgaccacctgtcaatcatattgtggaagggacccaggcactggagaggaagatgaacaacagggtctctaaagcaagcccagaaccccagatgtgtgcaggctgtgtagatgattggaaggagatggggcaatgtcacccatggggtgggaggggacagagctgatacctccagtttaaactggctgcccttggagagagaggaaatggcctgggaaattgctatctatcagcccatttaaaaattacatgagtttatggaaggtaactctctcagaggagttcattctcttcactctccaagtcatttaaaaatagttcatccaagccctaccccctgaatgcatgttccccacattctcccttcaatttgaaagtaagagggcttcctgtggctcatacctcatgcatattcctagccatgttctaatcactaactccaaagaacttgaaagaggaatgagaaattgcatttcccaactgggaaaaaaacctctgtgtagcatggcaaactcctgggctgggagagggagctgttacataatcagatcttgccccagttacagattcaactttattcaagaggagtcaagagacactgagcaggggagaagaggctaaggtttattgtgtacctactgtatgccaggctttgtgcgaggtgtcttacagaaacagcccttcaaggcgagtgtgtttcagtccacagcttcagggaggtgaggaaatgtgccagtgttcgcccaggtaatagtgaggagttcatgctctgacctagatctgtctgatctttctttccacacacctcacaagaaatctcagggctgagaggctaaggagccaaattcagctcattgccattatccggcagcttgtgagagcttgctgtgcatctgggatggcgtgcaaagatccactgtgttaagggaagaacaaggaacgggttctgctcccaggaggtctctagtgagagacagacacgactcactaccacttgagttggtggggcttgatgccacatggagagtgactgcagggagacctgaaatgagaatgactctctctctctctctctctctctctctctctctctctctctctctctctatatatatatatatatatatatatatatatatatatgccttgcctgacttggaaaatctctctcatgaggaaacctctccagaacagaggtagaaactatcaagacagaaacatcacagaaggcccaaagcaatgatctaaaatatttcccttgtaaaaatggcactctctctctctttctccatgcctgcttctcctctgggtgaaactgcttcatgttcccacagcaagtaagtctccatccaattgctataaacacctccaagaatgtactacagagctttaagcagcagcgtgctacagactgtactcagcctttggtatactttggttttcttcattcatgcaacaattatttagtaagtaaatgcctactgtatgccaggcactgctctaggtgctggggtttcagcaataagtaaaataggaaaagtgtccctcctcgcatggagcttttcattctcatggaggggagtgatactaagcaaattcatttataaacatatcatttcaggtcataatgagtgctaaaaagaaaaataaatcaaggtaagtggcagtgagaagaggggacactgagctatggcagctgggggagatgtttttgagaagatgctatttcactagagacctaaaggaagtgagggaggtgtgggtcatgcagacatctggggaaagagccttccaggcgaaggagccagtgcacaggtgctgagatgaaatgtgctgacagcatcccactacttatgaacttgttgcatttgccctattgggactcagccccacaaccacccttttagaactcttctgtgtcatgggggctagcagcctacaaactgcctgtccttactccctataaatgatatctccttactcccatgctagcagagtcctgttagattccagcagtgagaggcactgatgcatcgttagaggaagaaaggacctcttctgctagtcaaagttccagcaccatcagctgtggctcctggttagcctcagaggctgtggttcccacgtcatctgtgccaagaacatcagccacgttaacgagagcagctccagcatctgccctgctgccacagtcatgcttccagcagtgtcagtaagagatgggatcagttcttgaacccaaactcacctggcatcaaaactggctctgtaagaccacagaatctgggatatgcatggtgtggcccaaaaaggaggacaaagtttgacacaaatggaatgtgactggaggagagtagctgaactcagcctcggcaaagaggagcttcttttaggcttcagaaattagaagtgagccaatgccaatgcaactctttcattttgcagagaggtgagcactttgaggccactgggcaggccagtggctgagctgggactgagccctttctcctggaaaggggagggagggtgaacgcacgggctccagggtgactctgcccaactccttttgctctcccagccctactggcacctctgtaaccatttcctggcatccagtgcctctctgaaatattatttccactttcctgggtggaacattgaccaatgcactagctctgtgaccttgacatttcctcgctgagtcttagtcttctcatctataaagcaaaaggtagaaaatgtgtagactttaggggggtgaggactaaggtaatggttgccatgtacctagctctattcacttcctcttgctgctacagcaaattacaatggagatttatcatcttccagttctggaggtcagaatctgaagcaggtgtcactggattaaaattgagtgttgcagggctgtgttccttctggaggctctagggagaatccgcctgcttgtcttttccagctcctatggtccacctgcactccttggctcctggtcccattcctccatcttcaatgccagcaaccttgggccaactccttctcagattgccacttctctggttctctctctctttgcctcctttttccacttataagaacccttgtgattgcattgggcttaccctggtagtccaggactactcattccaaagtcagctgatgagcagccttaattccatctgtgaccttaattccatctgtggccctaattccttcatcatgtaacctaacatattcacaggttctgggaagaaggaagtggacatctttcagggtggggtggaggtcattattctgcctcccacactagcatataagaggaactcaaacaaaggaagccatgagatctcccaatcaaatcccctctttgtacaaagcaaaattcacagctttgtctgcccactgtaccactccacctgggtaagcacaaaaatgatgccaagtagatgaagacactatgtgtctatcgggaccactggagcagatgcttccctgggtagctggacactttcttgaccacagatggcttttcattttttctcaaactactttgccctgcttcttgtgtcccaaaacagctatgtccctaagacactgtctgatggcagaacaagaatcctcactgttcttggaggaagtttccatcctgacagaggtctgggattgttgctggaaaggccctttggtaccatccagcactatcctagccatgagcagatgaggaaacagtcatctggagagatgcatgatggccagttagtagcagagctggatttaccatggggaattttttaatttttattttactttaagttccaggatacatgtgcagaatgtacaggtttgttacataaataaacatctgccatggcggtttgctgtacctatcaacctgtcgtctaggttttaagtcctgcatgcattagctatttgtcctaatgctctccctcccctcagcccctgcccacaggccctggtgtgtgttgttcccctccctgtgtccatatgttctcattgttcagctcccacttatgagtgagagcatgcggtgtttggttttctgttcctgtgttagtttgctgaggacaatagctttcagcttcatccatgtccctgcaaagaatatgatctaattcctttttatggctacatagtattccatggtatatatgcaccatattttcttcatccagtctatcattgatgggcatttggattggttccatgtctttgctattgtaaacagtgctgcaataaacatatatatgcatgtgtctttacagtacaatgatttatattcctttgggtatatgcccagtaatgggattgctgggtcaaatcttatttctggttctagatccttgaggaatcaccacactgccttcctcaatggttgaactaatttacattcccaccaacagtgtaaaagtgttcctatttcttactggggggttttgagcccacttagtgctcattctgtgctgtctcactgtccctcggagggggagcaatgacacttacaaccacctgctgtgggagcctatgggtggtggcagagcccgaacacctgcttccaggagccttgggcctgacactagtccctgcccctatgtgccctggttctgacctcagaacctggagctgagctggttcttagagagcatcttgttctacttctgatggtgcaggtagagaaacacagcccagagaggtgttgtgaccaaaccagaactcctgacccctgcccagtgtcaacactcagatcccacagtctctctgcacctgctatgtggaagaactcaacaagattgctgtccaagaagtcattggtgaggaagcccaggagatgctgcatgttgttttaggacgtgtgcccctgaacatatgctcccagcaccgtctcgcctgcagatgcacccagtcaaacctgatgggtcccaggacctcacgctgggggcttaacagtttccattccactctttcctgcaggaagctctgtggctcataaaacattaaaatgagcactgctgccatttcatgaaatgcccagcctgtgaagaatgggttaagggatttttgggagctgttgtgtctgaacacaccaggcacatctgggaggcacatctatgaatctccttcctcattagcatggcagctcttcaccctagggccccagatggggcagttgtcttacgctgcctcctgcgagaaattggagcccttctgccaaaataccattgctatgggtggaatgtttgtgccccccagaagtaaaaagttgaaaatgaatccccaaactgatggtatcaggaggtggggcctttggggaggtgatcaggtcgggggtgcagaatccttacgaacaggattcatgcctttataaaagagaattacaaagcactctgatatccatgatctgatatgatcatttctctgggccctagagataagcattcacaggcaagaaaactgagcctttgagataacgggcagctttcctgagtcacacagctgtggtatggggaagacggggctggaccccagctctgctaactctcagctaaccctgggccacatgctgtgacacacagtaggccttccagagagccagggagcatgatgatactagcagcaacattaccaggtacaaagaggggaagaaaagtgtgtcaacttcacggctgacaccagaatgtttctcaagcactgtcatggctaagaaaaatatttagatgaatgtctggagcagcaggtgtctgctgaatgtctgcatgtgtgctggttccagctacagaaggggcgggaaggcgctcgacatgctagagggaggagaaatcggggctccaggggcatctaagaaagcagaggggatgatgagcagagatgacagggagaggaaagaggaggctgtgagtggcaggatggagtgactcccccaccaccctgaaatctttgatatggtctctaaactctctggtgatttgttgtacatgggtgctgttgtttttgagaaaaccaaagaaggtactgaatttcaagttgggactatcatgtcatcccaagagcaacagaactggtccccaagaagcagaggagactcaaagcacagggatgctctgaatggtaaagaaatgttgaacttccttccctgtgctgtggaattgaaggtacgttgagaacttcctcccagctctcaggggcacagagacctccagcaatctcaaaggttgcacgggaatggcacccatcacaggcacaacatagaaaacatcctctgcttcagcaaaaccctaagcaattctctaaatctaaagtgaggctggtccttacagcaagagttgcttgttctttaaaacgaagaagtgtgtgggcaatttctaggaacgacttcgtgctctgagggctggaggctttggtagggtggtttccgagctgtgttttcccgcccctttttggcccttgggttttctgtaggagacatttatctctgtgggcctctgtttcttcactcagcaccctgtcccaacaagttctctctagccagggaaaagggagtcctggggcttagctagtccatgggccaaaatgagaagactctcagaggccacctatcttggctcacatcttagaaatgaaacagagtaacagtgagggaggagggcgctggtcttccgggagcaggtgactgccagcagagaccgagagaagacctctgaggcagtgcgtccccacctccctctgcccagctccctctgcccggtttaggagatggggacatctttatcattgacaagggcaagcatggaacgttacacagcccctcttctctcctcagccatctccagatgggtataggtgagctgagggcctccaggtaaggccaccacagacagcagggcctgaagagccagctgatcaccccgtggcctccttcctgggttctgcgttggttgttggtgggtgtgtttggtgcacaggtgagggagtaagcgaggagtttacctctgttgcccctccctcagcaagagcctacaaagcacaaagcccagctccctcaagcatcagcggcctccgtttgtgcctgcatttacctgggcctgcccgtatctatgatgtccacacttctgtgatcacacagattctttttatgttctctttgttcccccccgaacattatgtcctaagcatgccttcataatgctacaatcatctataattgtttgttaaataagtgaattaaattggcattgggatatcattttcagttttaagcagatacacgattacttatctaactgttcttagatgaaatggatgcaaatctggaatttaaccctggcttaatatataaagtcataatatttcaggagaaattttctgtgtctccaacccatggattaatgatcttttgctatttttttttttttttttttgagatggagtctcactctgttgcccaggctggagtgcagtggtgtgatcttggctcactgtaagctctgcctcccaggttcacgccattctcttgcctcagcctccagagtagctgggactacaggcgcctgccaacacgcccggctaattttttttatttttagtagaaacagggtttcaccgtgttagccaggatggtctcgatctcctgacctcatgatctgcccacctcggcctcccaaagtgctgggattacaggcgtgagccactgcgcctggccgatcttttgctattatggttgtctttatgtgcacgttatgtcttataaataagagtcacacacacgctcaaggcagcaccctgcacttcagtgaattcaggtttgaatgagacaaactgagttagaatctcgcttctgtgatgaactatctgtggtatcttaggcaagctactcagcctctgagtggtcatttccttgtctgcaaagttttggagatcacagaagcaaagcaccatgtgtattgcaggcactggaggctgggattctcctaaactgacaagggtggcataaataaataagacccagggcctgggactcattccctgccactatgaactgggggtggggatggagtggggataggaacatcccgaaaggggcctcttgtctgaagtgattgtgttgatggcccaagttcgtggcctccctacgtttatgtcctctaccctaaaactttgaagccccttccactctgactttgggttagctatgtgacttactttggccaataggattttaggagatttcaagcttagagaaaacgcttgtgttttccatttcctctctgattaccatgagaatgtgccctgctggccagctggggatgaggtgcattgaacagagctaaggccaacctaggtcagccaggtgaccaacagacatgcgagtgaacttcagctggccccaagaaagattttaaggtcaagccctactaagattaacagaacaacactgttgacctataggtttgtgaactggggcatgctattatctaaagccaatgtgttttgggtgttttgttatgcagcattattacagtaatagttgactaacacagggcctcttttccccaaattatcaacagactggagaaggggtatctcccacagtgccgagcatggtgctaagtaataaagtgcattttgtttacattcataagttccagagccagactgtcagaattcaaatttcggtgctgtcattggctagctttatgtccttggccaagttatcccatccttggtttttttttttaggtcttaaaatgggaataaaaatattacctactttctatggttgttgtgatgatttaatgagctaatgtatgtgaagtgcttagaatgaaatagttttcaatacagatgagccattagtgggtgtttctgtccatctcccttaactagaccttcaccctccctcactcctggggggcaggaatgtcatctcataccactgtctcaccctgtcacctggcagaacacccaacatgctaaatatccattgcttgctgaatgtctggagtaaaattagcacttttataggtacagatgaaaatttcaataagctatttcaacttaaggccaatatctttgttctttttatagagtgcacatgtaatatttatcacgttttgtaactgtacttctccctcactccctactgtgctatgaaataaaactttaaaaccttcttcactgtctggcattgacatgcactattcattccaactgtacttaattgaagcatttctcaagagagccagagggggtgcgggttaccctcccaggctagtagagacagagctggaggcctcaccctcttccaataatgcacagcccaggtgcatctagaatcagatccccttggttctctctcttagtcaccttctttttactccagagactctgccatctgacaaccatctgaaccaaacttttaggtggtttttctcctcactggccacatgggaagtcacccggtacaatagccactacttccgtttcctggtatctctctgtgcacgaggggtgttggaggaaaatcttctttgggttccaatcctttggttactaacgggtttaagattgggggtgggagttactaaccagggtcctctggagaaaagagggctcaagtcccaggtctatcaccaagccataggcagaattttgtgtatatggttactgtattgaagaaaacactatcatttccatcatattttcaaaagcctctataaatctctataaaccaaaacccacagctttgggaaacggaattcatccctgtaagcctcagtttcttcatctgcaaaatgaaggtaataacaattaccttctctgacttcactttagagaaatgttataaatgagaaaatgaatctgatccataaactgctagacaaatataggtaattgttaatatttcattatgccatttgttaactcagaaaatacttaggtagtgtgaatttcaaaagatgttgcacaaattgtatatataattctcaagtcttttcctggatttggacatagatgaaatttagaactaaaatgcacagagttctcagtaataatgatagcagataatactacgaaccttatatgcaccatctaattcagtcctcacaatggccccatgagggaagtttatgtcatttcctttttacagatgagggttctggggctcagaaaggtttaaaaaattgctcaaggtcagacatcagagctggatgtgaaggtagtgctggttaccttcacatgcctaactaaccatggtgctgtcaactgcatctcattttataaaactaaaagaatcagaatgtgattgttcattctgcattgtctatctctaggcaacataattttgccttttcagggctctgtagagagatgtctctgattccgaaagccaagatttgaatctgactcagcatccccccatttagggcatttaaagaaagctacatgagacaactcccaagcccctttgcgagccttatttttctcccctgtaaaatgagtgtatactccttcctccctcgaaggactgttggcaaggtcctgtgggtcattgtgaagaagcactcagaccagtgcctggtgggatctggtgttcactctgtgcttgcatcttttcctctcctggcaggtaaatattaagacagaggaagtcagtgaagggagaagaagtggaaggagggccgccatgcacctaagccactcagaaatttcagatggcttcatctctgtggctgggaacaactagagaggtggtagtgagacactgcacagaagtgagggaacctgcgtcttatcttgtctgttctggcttttccagattccctgggagactccctgggtgactctgtgtcccctctctgtcccccagcaaggctgttgggaagatgaaatgagaaggtaccctatgatacccagcccagtgcctgcaaaaaggaacaatgacaacaccccttcctgtgcccattggcccaggtcccagcatgccttgcagtgatgatctatgcaggggctggagctgtgcaggaaagggaagggccctcacctttcacagctcttgcctcgttgtgcttctccaagagcaggtagcgtgggctgtccgggagaaagggaaggctcagcagctggacaacggcagggaccacaatcactccaaacaggtatggccaggtactctcctgtgggagaaggagatgctgctgagtgcagtggcctttggtcattgttgaggggactgggccactggaccaggtggtttcgaccctgcagaaggtcttcctgcccagcatgatccccaggaacaaaggctgagggaaggaactgagccaggctgggcaccagtcccacgtatatagcattttccatgcatgagtccagagactcctcaagagtcccctgtgagatagtgacctgcaaggtagctctgaaaagcaggcggctctggttggccaaggccactcaagggctgcttgaccccactccctggggaaccatggtgagcctgggggatcttagggtctccttctcttcaacaccagggctgcctcccaggctgccccaagaatggagcctgcatgtggaggtgacatgggcaccaccgctagatatctagacgcccacgacattcaaccatctctgtcttctcagtgaggacacaagaagggcagctggagctcttgcagaccccatgggagtgaggaagagggggccagtggggcacagcttaccccttagggagaggaggcctttcactttccagccagctatgaaaggcaaacagatccctacgacacgcactattcaagaggcaagtgatgcactccaagcagtgacatcccctgcagtgcagcttaaatgaagcccagagcacacgttacgatgcccatcaaggtagtattcgtcctaacctgctttcttcctacccaagtttacaaataggctctcagtgtgccactgaaagaagagaatcctgctcacaatgcagttctgatcatgagaaggaggaaaaaccaagtcctcaatgccacatccttgacacgtttatttcccaagaaggtacaaggagatggccaagggcaaaataagacacactcagacctgaaaagacttcacatgataggcagaggttctgttggcttcaggtggggcccatgggaagttaccctcaggatcctggggcaccagaactggcagggcctggggacagcctccccacctctcccccagctgcccgctgggaggcagggcttccctctgctgctctcccaagactcgctccctactgaggtccatggtaacagagacttttgcaagttctaggatcccatgaagggagagcagcagggccccagggctcagagtgagtggggaagtggcctgccaggggcacacagccagcagctggtccaatcatcatctccatctaaggggtgccttagatttgattcccttttctgtatctaataacaatttttattcacaaaactcctctggttccgccagccagcatagcccttccatcgccctttgaggaactggcaaggccaatgtcagctttccagtttcaggaggagctctcgctagaaggctgggaggggtaggctagggctgtcgggggcccaggagggccagggacaggggagtggggagtgactgcgcatgggtgtggggtttcatctagggtgatgcaaataccctggaattagggaaggccgatggtggcccgactccgtgaagataccaaaacccactgagctgtatactttaaaaggatgaattttatgatatgtgtgtcatagtttgatcaaaaagaaagaccaggaagaaaaaaccccaacatacatagaagtggaattttcgctaggcctgtgtgtggtggtgttgattttattttctctcggggtttggctgccgtctcagtaagggtaaaaacagaatctgagaaaacacgagggaaccaaccccatgaagctcctaccacgtgccggatgtgatgtgagcccttcccatggctgtctccttccaccgcacagccgccagccccacacacagccagcaatactgctgcatgttaaaggtgtggcaggcgattcctgtgctgaggcctcccagccaggagccacacaggtggaaatcaagcctaatattttcccacagtatcgtcacagtgggagcacttcccaggggtggtgtttttggagctgccactgggtggaagggcacccccagcataggaacagcatgtataaccacacagaggcatgatccacccaggctcattggggaacaacaactgtagtggaaacagaaggtcaggggatgccggagatgtgggagctgaggctggagccttgagcagaggtcaggtcatgggtggctttgctgcctttccatggctcttggacttggcttgaggacaacaggagcctttgaggggtctatgcactagctgagatggacactctctatttccttgaatctacaattcagtgtttttggaatcttagtcagtgggtatgtttcacattgcatgacttattcctgaaaggctgttatcaagtttatggcatagcctttgatccctggtctcttaaatacaaggacgtgtggactctttcttaaggggggtcgcatgggtgaccatggtcttctttctacctctggagaaaaggtggattctttaaacctcagggtgggcagcccccggattgggatgccaacatttctgaactggggaaggacaatggcagtggccactctgcacacatccctggggtgaacagcggaaaaggtgagggtcgggagtgtccagagtggagctcagataagagtttactccagagggactgagcttagccagcagaagagtctgaacctggctttttccagcaagtgttcagagatttcctggagatattagctggctgcagggagaggtgttatagttaggagagattattcccctcaccttctaccaagaaaagtgtgactgggtgtgtgggtagggtgtgtgttgaatgaagtgtttccacccatattatacatgtggcccacccaaataataaaaatagctaggatgacctgcgcacacgtcatctcaatgagtaagtgcctagcctgctcactcattcctgccgtggggccacaataaaggctctgctatgccctgtgctttatggaagaatttctgacaatgaacatgcacgtcttctctcccaatgacagtggtaaagatgtaatcgccatcagcaacccttactgagcaggggcttgcagccaggatcagggcaacctagtgagtggctatgggcacagctctcttgcaggctgtctggatttgaattctgcctctacccccactcactgtgctgtgggcaagttatcgaaatgcctatgcctcagtgttctcatctgtaaaatggggacagtgacaacacgtattcctagggaggatttctgttgggaggatttagtccatgaatggatgtcgggagtgctgagcacaggcctgcacacactgtaggtgttcaacaggaaagagtggcttttattactaagcacattggatagttcatctcttctcatcctcacaatagctcgcagacagagagcctgtgattatctccactatacagaaatattaactgcagcacagaggggttcaatagctcattgaggccacaactcggtcatagaggcatgactggccgccaaatctgggatcccagagtctgaattcaaatccaggaggcctgataagacatacctagtgaccagggaggagccatcagaccaccagactcaggggaagggccaggagagcttggtctgaacttctaccatctgacccaggcctaagaccctcagtggcccttgatggagctcctgggcacttggtcccaacacagagctgaggcctcagtgttttacattagatgggcatggcctgaaggcagagacctgctagcacacagtagtggttcaatacatgtctattgaaggagcaaatcagcgtgggaaagggctttcctacacactggtccctttcacaaacagcgcttgccattttcagacagtggcctctgagtgtctttttcaggtgctgttcaaaaaggaaggcatgttttaaaaaaccgcatattactcgcctgacacaagaccatgaggcgccaccaaacgacaacctcaaagatgagtctttgtggtgtcggtccagcctgctgggtttggtaaagccctagagcgtccatctaggagaacacaggcagagtctttgcacctgctatttcactcaggaggaaagaaaaggatagtcttgtcagccaaggtgatttttaactcccagtcaggtcaggcgaatgggctttgcaattatcttgttctattatcttgttctttaatctgcaggtttccatgttttaaatagacttccaggtcatatttcccccaagctatagactactttagtccataaataatatcatcctggactatgatgaatcagcaaaaaatgtttaagtagagttgaaatcattactcttaccccaagtcaagttcttataaaggatgttccaatatgctcatggcccccagacaagggagcacggtgagggggttgatgctggctgggccacttatgcctctgacagcaaaagggctccagaagtggccattgctccatgctgctggattggaaaggggaagagcaagccctaccttacacagctatttgggggattaaatgaaatgctcttctttatatttcttcatatttaggctcttattctaataatggcttacattgatcaagtgggctccacgtgcccagctccctgctaagtgtgttacaaatgtaaccttgtgttacataagaacagtccagaatgtcatctaaatacaaccttgatctttgtctccttattcctctaaaatttaatccctggggctttatttccctgccccattctaggggctcatgtcttttctgctgaaactgagcagagtcctatcctagaatcacaatttcaatttagacatcagaattgccagtataaaataataatcaaaatcaactgaattgaatggattgactgacacttcttccatctcccataccccttcctccaagcctgctttaggctagaagcctgcagtggaaagagctggggtgggaggtagatggttgacttctctatttctctcctccttcctacccctcttccccaggcttgctagccagtgtctgacccctctaggaaccaagtgtgtgaggctgtacgttgggactctggggccaatggatgtgtaaaactgatattgtttcctcatgagcactttccgagggttctggagtgtcccaaccttgggaccacccactcgtccttgcagttgtcctagcctgcaggtttgcaggtgctctttctctgtctctgctgcaaggtgtacatctctttctgtctctctccattgcagctcaagggatccagggtcaaggctgctctgcatatttgtgaaaggtgcaccgagcactcagctccctgataagggggtgggctgaggctaaatccagcccactctgaccccaacctaggtggccatgaggttagtgtattaatattaatcatgttttatgtgttctgtattttatttcgctttcatattgtatgacctttctgatttcagagagaccgacctttcccgagcagttattaatagcagctccctagctattaataattcctagagctagtaaacaacctgcctgagagcaggcctttcgtatgcaaacccaccaatccaaagtctatactccaatcacttcctttatcaaactctcacactctgagccaacatttcccctcccacaggccactccagagccaggtatcagacaactagggaacagccctgtagcccagagcctggcaacatgatctcaagcctgcctcccctgctcactcattcctgccatggggccacaataaaggctctggtgcaggctgtcccctccctctttctgcctcctgactgacccagtgcttccctgcgtggtcctgcatggcgtggtatgtcccctcctctagggaactgtgagtaataaattcttctttcagataaggttgcctccatgtccatcacctcgccatacaggattcatacaaattctgggtacattttagaacagctggttgcccctcccactcaggcatgtatgttcttgctgtaggtggccacttatttctttctaaacaccacccccccaccccttaccttccatgacacactctccctggttctcctccagcttctcgggatacttatccaaggttttgaggcaagccctcctctcattcatctcacacacatcccccgggtagtgattcttgaacttggctgcccattggaatcacttggagagtttttacaaactactgatactcattccttactctcagagatttggggttaattggtctgggggtgcggcttaggtgctggggttgttcaagctctccaggtgactctaatgtagagctatttgacggccactgtcctagggcttcccccacacctgcgtcacctgcagtgaatggtggtgcatggcccagaactgacaagcttgacttatagctgctgggagcattactggctgtggaccacagctgggcctgtcctctggaattgcccttgaaggatgtttcctccaccaaggctacccagccctccccaagaacaaactgcatccaatggctgactgatgtgggggcataaagttctgttcccccacctccaaattatcccactctgatgggccatcccagctccagagctccctgtgggctcaactgagacctctgttgtgctgagggttgctcaccttttccctctgctgaatcctggtcccatctcttcccctgcaggcactgatctgagctcattctccaatcagcttcctgcccacatctccatctcagggtctcttttctggggaactcaacctaagacacatctatgggcccatgattccaaatcttcatgtccatccacacatctgacaaaaattatttacttggccaaacattagtcagcccattgaaacttctcctaggcccatctgtgtacttccctgtaaaatacagctttagcaaaggacgctcctaggccattttagcaagaacccctttctgcagcacatctatctactcatcctttaccttatagcattccctcccgtggatgacttctctatctggtaccaatttccattaaagcacttgttattctgcatagcaatgtgctttttatgggtgtgtttccctatagacggagctcctgaagggccacccattgccttgttcctttatttatctgcccagtgccaggtaaaaggcaggtgtttagtaaatgcctgtttactgaatgcatgttggggaggatgaatgacagcacagataagagatgctccagctagatacagaaatccctgaaacgacagacactcctgctcttaaaatactttttataaaaatgctaaaactgtcctatatgttgtcctattagagggctgatgttttatagtattataaataatattttcccacaaagtattattataatttctagtccatagaagagaaaatgtagacctgtaaaggtcaggtaactcatgccaaggcacatgagaaattagggggtctggcagaacaagagcctggctcttctgatccctgtacggggctctttccttgacattattcctcagatctgcagttcctggagcaaagcactgctgccttgccaccttcccttccctcatggtggcagctgctagctgaatagggaatttatatgcagattctatcaggctgaacctgtcacactcctctatggcaggtcctatacagaactcatcagtgatcactcaagctcaactccaatagctcatgctattacaaaaacatcaagatagtgaagcctgcactcacattccatagggttgctttgttacatctttgaatgcttcctgcttgtttagcagtggggcctcacagggaaatagtgacagccagcaaatgttcatggagcttctttgaccttaccgtccctcccaacaactgcctcctgggaaggaccctgctggccacagctttactgaatcctggggtggggagcatgtggctggtcgtgtttgccttaccaaccttacctgttgggcatgagggtcaatgtcaccctctccacacctgaccccacagagtacaagccagctagtaagatggctcaattcattgcagcaaatatgttgttctagaattgctatttttggtgcgcattcatgctctgattctatttcaacactaacaataacaggtatctcaagaacatgggcttttgtgattacctctcatttttctctgttggaaataataatgagatgaacttccaaggctacaacactcaccacacaaaaagtggttttgagaattggatgtgagagaagcacccacatagagcccccccatgggtcatctttcaagaaatgctccttcccctattcctaaaacattttctatttttcaaagggtttggatgtcctctgccttgcttggttctcaagcaatcttatgggaaaaaatgctcaatatcactaatcatcagagaaatggaaatcaaaaccgcaatgagatatcatctcacccctgtcaaaatggctattattaaatgacagatgctggcaaggatgcagagaaaaaggaaaacttaaacactgttcatgggaacgtaaactagtatagctgtgaaagaaaacagtatggagagatcgagaccatcctggctaacacggtgaaaccctgtctctactaaaaatacaaaaaattagccgggcgtggtagcgggcgcctgtagtctcagctactcgggaggctgaggcaggagaatggcgtgaacccgggaggcggagcttgcagtgagccgagatcgcgccactgcacgccagcctgggcgacagagcgagactccgtctcaaaaaaaaaaaaaaaaaaaaaaaaaaagaaaacagtatggagatttctcaaaaaactaaaaatacaattaccattcaatccagcaatctcacctctgggtactactcaaaggaaaagaaattcatacgtcaaagggatacctgtactcacatgtttattgcagtactattcacaatagtaaagatatggaatcaacctaagtgtccatcaatggatgaataaagaaactttggtatatatacatcatggaatactatttagccattaaaaagaatgaaatcatgtcatttacagcaacgtggatggaattggggggcattaactaaagtgagataagccaggcacaaaaagacaaatattgcatgttctctctcacttatatgtggaagctaaaaaatttgatcatatggatgtggagagtgtaaagatagataacagagacagagaagggtggtggggtgagataaagagaagcacgctgaagggtataaaaaggaataaatccaatgtttgatagcagggtaggataactaaagttaacaaaaatgtattttattcaggtgatggataccttaaatattctgactcaatcaccacacaaatatgtgtaacaaaatttcacacataccccataaatttgtacagataataaagaattataattgccatatcccacttaggaaggcttgaggagtaaatgtcaaaatgtcaatatggaatcagaaaagtttatttttaaaaaaacagtaatcatctttaggaatttggctttttgagaactgtcctttctgtctaaaggaaatgtacttctttctagaagaataagctaataaagatgtgagaaatcaaattttataaatgttcctcattattctcaatggaaaaaggtggtatgaaagtttttgatatggaatctttaaaaagcttgaaaagtaaaattgtcagaaaaggacaggaaatttacaaaagattcatttaatgtttggatgaatggttgcagaattagagtaggtatcaaagcagtggggttaagctgactgcctggaaggcagaggctaaagcactgtggcttccatgtgccacggctcagctcataagactcccaatgccacagaagccaagaaagagagtgccctctggagttggcccacctctgaggttgggtcctgaaccctggtcctgccacttactgattgtgagataacagataaaccacttcacccctctactcctcagtttgctcatccgtaaagtttagtccacagaggaggacctcacatgcagtaggggctttataagtgcttgacataattcgaatatatgtccctgccaaatatcatgttgaattataatcgccgatgttggaggtggggcttggtggaaggtgtttgggttatggggttggatccctcatggcttagtgctgtcctcatgatggtgaatgagttctcccaagatttggttgtttaaaatttgtggcaccttccctagccttacttctgcttttgccaggtgatgtgcctgctcctggagccctccccagaagctgagcaggtgccagtgccatgcatgtacagtctgcagaaccatgagccaattaaacctcttttctttataaattaccctgtctcagatctgtctgtcttttttttttttttaaagacaggatctcattcagtctcccaggctgtagtgcagtgacgcaatctcagctcactgcatccccaacctcctaggctcctcccaccttagcctcccggtagctaggactacaggcatgcaccaccaaggccagctaatttctgtattttttgtagagatgggatttcaccatgttgcccaggctggtctcaaacccctgggttcaagcgatctgcctgccacagcttcccagaatgctgggattaccggcgtgagtcaggtgtttacagccgtgcaagaatggccaaatacaatgtttgataaataatagaaataacaatgtcagagctgttttggaagagatttctgcattccagaagcggtcgggtcattttctgctatggtcaatttctattcacagattctgtgatctgaatgtcctataactctaacaagctgtaattcttgcattgtaagatgctttgcaaaagtcctagaatcatacacttgtgattttaatgttctatatccaagtttctctgattcacaagttctgtgactttaattcttcagatcctaaaagtcttttaggaggttcggatcgcatcttggtcattcctgactggaaactgggcaaagtggggcaagcttagcttgtgctgttttccaaatacccactgaacccgctatgcctcttggccatgggtaggaggtagagaaccaaagcccagagagccagtgcttctcctgaggtaacatcattgggcagtgacgagaggtcccacactgtatcatctgcctgtctcaaatctcagccacatgctgttgcttaaagagctggagccactgagggccaggtgggcccagatgtgggcactggtgccttgcccatctgagtttgagtcctctcctcactgcactgcctgctcccttggtcattttggacctcaaatttaaatttaacctctatgagcctcactttccttatcaataaaatagagataataaaacctgcattactggttgtgctggggattcaacagattacatgcaaagtgctcagcctaatgcccagtttaggagttttttgtttgttggttgttttttgagacagggtctcactctgttacccaggctggagtacaggggtgcaatcatggctcactgcagccttgacttcccaggctcaggtggttctcccacctcagcttcctgagcagctaagatggcaggcatgcactaccgtgcccagctaaattttgtttgtttgtttgtttgtttgcttgtttgtttgagatggagttttgcttttgttgcccaggatggagtgcaacggcaacatcttggctcactacaacctccacctcctgggctcaagcaattctcctgcctcagcctcccgagtagctgggattacaggcatgagccaccatgcccggctgattttgtatttttggtagagacagggtttctccttgttggtcaggctggtctctgactcccgacctcaggtgatccacccacctcagcctcccaaagtgctgggattacaggcttgagccactgcgcccagccctaattttttgtagagatgaggttttgccatgttgcccaggccggtctcaaactccggggctcaagagatccacttgccttggcctcccaaagtgctgggattacaggcatgagccaatgtgcccagccaatgcccagttcttagtaacactcactcaacagctgtcactgttaccatttcacacagcccaaagggcctggccacagacatggggctccccactggaagacttgtctgcaactatatttgtttggacctagattgggcaggaaggggcaacccttgctccccactcctctgggctacataaagaagtctttgcctacacactactgacctcctgctctgccctaacttcacgacggagttacttatggggttactgggtgacagccattggtctatactggctggtggctggcatgtggagccatacatgcagggggtgagacctttttctccctcttcctctggatctgggtgtggtagcggccctgggtgagtgggtgtctacagactctacagacccaaatgttcccttgggtagagggtgcaaggcccagacaagacctgcttcctgctcacctagccaggacctaccatgacccctgatgagtaaaagaggtagtgtctgacccctgcctctgttatagtgggtagtcaggcattccccaccaggaatgtcaggtggccatcaggtgatggtcaggcagttgttaaactgtctctctaaaataatagttggtcacagctggcaattattgggaaaggcagtcagtctcccaatagaaaaaaacctaaaactggtgatcataagcttcccgacaagatctcaggagttgggcgagtgggctcaagcatatgcacgaagaggcaaaatggcagagtttacctggtatatggccttcctctgggaacttttgactggtgagggaaaaacgcctcaagtcagcatgtgcacaacgtcagtaaacacacggcgtgtgcggcccctcctaagtgctggcaggccactgtgcatgcaaacagcccaatccaaggggaagaatcagggagaggagacgcaaccccctggaagcataacatataaaactccaagtcggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactggggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaactccaagtcaaagttcaaaccgtgcacttgatctctcaagtcgctcccttggtgctctccaagtgtactttacttcctttcattcctgctgtaacgctttttaataagctttcactcctgctctaactcttgcctcagtctctccctctgccttatgcccctcgtcaaattttttcttctgaggaggcaagaattgaggttgctgcagacctgtatggatttgctgccgcggacacctctgtctctcaaagattccagatttgggtcagtattaaccttttgagccccactggacattctctagggattcttattcagaaagtctgaggtagggctcaagcatctggatttttttttttttttttttttttttttgagatggagtttcactcttgttgcccaggctggagtgtagtggtgcaaacttggctcactgcaacctctgcctcccatgttcaagcgattctcctgctccagcctcccgagtagctgggattacaggcacccaccaccatgcccggctaatttttcgtatttttagtacagatggggtttcaccatgttggccaagcttgtctcaaactcctgacctcaggtgatcgacctgcctcggcctcccaaaatgctggaattacaggcgtgatccacccagtgagcatctggatttttaaaaagtatcatcggccgggtgcagtggctcacgcctgtaatcccagcactttgggaggccaaggcaggtggatcacaaagtcaggagatcgagaccatcctggctaacatggtgaaaccccatgtctactaaaaatacaaaaaaaaattagccgggcatggtagcctgtagccccagctactcgggaggctgaggcaggagaatggcgtgaatctgggaggtagagcttgcagtgagccaagatcgtgccactacactccagcctggacaacagagcaagactccatctcaaaaaacaaaaaaacaaaaaaacaaaaaaaagtatcttcggccattctgatacacagccacctccacctatgagcctcttctctggaggaattgagagctttgttaccagcggcgttcacatagaggctgggtgctatttgagtctcagtctcccatttataatatgaatgtctcaggctttccttaaagggttttctagggctagcatttcaaattgtgatcgttctaaaatttattcatttgaagtttcctgggtgccttttgtgtattgggtaccgaaaaatttttttaaaacttcttgataaacaaggcagattgtccatgccgatttatcttatccattccttaaacgtggcagtacagacatttcaaaggtattaaccacaaggacatgggaatgcaagaaatggcaatggtgagcaagaggtttttagcccagttttagaagatggaatagcaaagtggaggaagtggcactcggagcctctgtgggggcactgaagggaagtgaagacatttgccccaaagacccctggtggctcagcatggaggacccagcaaagacagggtgagggtgggaatgaaaacagagttttggtggcaggcctttagcctcatgccctttattcacttcttgatgggaaccagaagatggggttcattctcacaatcaatggaaccacagtcattccaggcttggacataccagatacagcagcaaaacaggaggccaaaaacatgaaaataaatctcagagccctcagtaatcagcagtgaatcttttcccagaataggcatctcccattctttggaggagaatccaaacctccaaagagaaaaggcattcacacactgacttgtggggcctcccaatacaaatcctgctcacgctgtcatcactcttgagtgaagccttgtccctcacccacagcttttgctcaccttctttttaaatatgaatgggagaaccacacttttgaaaaagtgtctaacacaaaggagaaaggcaaaaagaaaccaacagaaagataaagcaatctggagcaaagagacaaaaatgtagcagcagaacaaatgcagggggcaatacaccctatcagtaataccctctaaaatatagttgtaaatattatatctaaaaaacaagaacaggactccatgtaaaatgaacggggacagggggaaagcccttagaaattaaaaatatgataaaataataaaaatacagtggacaagttggaagatggatttgagaaaatgttccataaagaacaaaatgataaagagatgaaggaaaggacagaaaatactaaaatcaaacttagaagagcagcctattatctgactgcaaggagtttcagagaaaggagcaagaatagaaaaatgggaggttaggagaaaattatcaaagaagtaacataatgatctagaatgaaaggaaatgagtattgagaattctgcacaactgaagagaaagattctcacctatggaagtaatcatacaatttcaaaactagggataaataagaagattctaaaagttaacacagaaacaacagttcacatataagtgatcaaaaataagaaaggcatcagatttctcatcagcaatgtcagatgctacaggacactgaagcaatgccttcaaaattctgaggaaaattatattcatacaagagttctatatctagcctaactatctactgggtataagtatagaataaagacatttttagacatggaaagtctcaaaagctttgtcttcattgcatgttttcttcttaagaaagtactgcaggaaatgatttagcaaaacaagaaaataaaccaagaaaaaaaggatgagttcatgtactttgcagggacatggatgaatctggaaactatcatcctcagcaaactaacaaaggaacagaaaaccaaacaccgcatgtcctcaactcataagtgggagttgaacaatgagaacacatggacacagggaggggaacatcacacaatggggcctgttggaggtgaggcctaagggagaaataacattaggagaaatacctaatgtagatcacgggttgataggtgcaacaaaccactatggcacatgtatacctatgtaacaaacctgcatgttctgcacatgtatcgcagaacttaaagtacaataataatttaaaaacaaaacaaaaaacaagaagaggaggacataggatccaggaaccagtggtttctacccaggagagaggcaagaatcccaggactgttctgcaccaggacctgtccagaaaagacccatttagacgaaagcaacaggctagagggctgaggtacaaaaataaagtggtagaacatctgtgatatacttaagaattttgtaaatttattaccaggtgtttaatgttggagaatttgaaaaaaattaattgtaggtagttagaaaactaagcaaataagaaaataaaaacaatgatggaattaataactccaggaaaaacaaaaggttgtacgagaaaggaaagtaatcggtaaatagtcataccaatataaatgttaaccagtgaactaataaaaaattgtactatatgtgtattggtaggttagagaaggggaagggagggatggtgctggaagaatgctaaggcaggtggatcacttgaggttaggagttggagatcagcctggccaatgtggttcgagatcagcttggccaatctctttagtgagatttaggccaatctctactaaaaaaaaaaaaaaaaatacaaaaattagccaggcgtggtggcgggggcatgtaatcccagctactctgatggctaaggcaggagaatcacctgaacctgggaggcagaggttgcagtgagctgagattgtgccactgcactgcactctagcctcggagatacacgaaactctgtctcaaaaaaaaaaaaaaagaatactgaggcctcaatcatcagattgatgtctcaatcttagacatcaatggataatatctaaagaaaatgaatttaaaagttctatcatcaattattttaaaatatggtggaattatcaaataacaggtaaaagagttgtaagagattgcctctggagagcagacagggagcttgagggggtgggacgatggacctctgtgtgtcactataagccttttagcagtattgaattttttcaatcatttgcttgcattgttttgactaaaataatttaaaatttaagacaaagattagttgaaatatgaatacttttcctttggggttccctttgtggagtttcaagtgcccctttgagatttgtttttggtagtgaatccctggtctacactctcaggctccatttgctgtgactgagctgcacaaccagactgtatcctgggcctaagaaacgtggatgttctggctttcggggaggggctgagtcacattcagggtccgacttgactgctagatgaatttggtggtaggcagggagataatttatttccaagcattgtcccacttcaacaccacgcccttctgggcaggaaccagggctaactgggttatattctcccccagtgtttaaagcatggaaaggaatcattatcagtgggcattacttggaaaagccgcaagtcaagaagttatacaggagaggagccttattgttccaaatattagaatttgaaatctgccagaagcaacatctgtctcatccagttattgaagtgcagcatttgaatttacatctctccagggccttgagcctacccaagtcactcaggctccgctaaaactgcacagactggcactaaagatgcaaaataggcctttctgcctggaaaataagttccccttcaccagccccaggtatcaccctctatacaagtaagttaatacaaaatgctgcctaactctccccatcaaatacctaagttggtggacaatattaatgatgcctactctatgctgggcagtgccagggaagaaaggggaatatgaacaggagtggcccagccccttaagggtttacagtgaaggtgaagtcagagggaagcaagaagacacagctcctccccatgtacccctatctgatcaaaggcacccacagcatgtgaaaattcaacagaggaagagaaagcttttgtcaggagccaaagctcacgtggcattcagcatctcttctcatttccattttcagaagggctgtgaaaatgctatttcttttttgttgttgttgtttgaattaggcttttcttgaaggctgagtgacatggattgagaggggtgatgagagaggtgattccaggcccagggagtggcatgaggattatgggatgatagtcagcagaagggaaatgggggcagttgaatggcactagaggatagaatgggttaaaattggagactgaacccaaattcgggagccttcaaggctagactgagggattagggcttcatttggtggacacaggatctgttgtttgactggatggctcccatttgcagaaacggtacaaagtcctttacatatagtgtctcttttaatcattgcattaactccatggagtatgtattaatattattgtcctcattttacagaatcagaaactaagcctcagagaagtgaagtaacttgttcaagtcatacagctagaaagcagcagaggtagaattcaaacctttaacttcctaactcccaagtcagagcaatttccgtcatgctatgccccttcccacagagaggcttggagtgacccagccaaagcacagtgctagaaagatgtttgggcagcatatagccaagacaatcctaagcaaaaataacaaagctggaggctggcttcaaactatactacaaggctacagtaaccaaaacagcatggtactgatacaaaaacagacatatagaccaatgaacagaatagagaactcagaaataagactgaacacctacaaccatctgatcttcaacaaacctgacaaaagcaatggggaaaggattctgtatttaataaattgtgctgggagaactggttagccatagacagaaaatggaaactggaccccttccttacaccttatacaaaaattaactcaagatggattaaatgtaaaacccaaacctaaatgtaaaacccaaaactataaaaaccctagaagaaaatctagggaataccattcaggacataggcatgggcaaagatttcatgacaaaaacatcaaaagcaaaaattgacaaatggaatctaactaaactaaagagcttctgcgcagaaacaaaaccaaacaaaaaactatcatcagagaaaacagacagcctacagaatggaagaaaatttttacaatctatccatctgacagaggtctaatatccagagtctagaaggaacttaaacaaatttataaaaatcaaacaaacaaacaacatcattaaaaagtgggcaaaggacatgaacagacacttctcgaaagaagacattcatgtggtcaagaaacatatgaaaaaaagctcaacatcactgatcattagagaaatgcaaatcaaaaccacagtgagataccaatctcatgccagtcagaatggagattattaaaaagtcaagaaacaacagatgctgatggggctgtggagagatacgaatgcttttacactgttagtgggagtgtaaattagttgaaccattgtggaagacagtgtggcaattcctcaaagacctagaaccagaaataccatttgacccagcaatcccattactgggtatatacccaaatgaatataaatcattctattataaagatgcatgcatgtgtaagttcattacaacactattcacaatagcaaagacatggaattaaccgaaatgcctgtcagtgataaactggataaagaaaatgtggtacatatatactatggaatactatgcagccataaaaaagaacaaaatcatatcctttgcagggacatggatggagctggaagccattatcctcagcaaactaacacagaaacagaaaaccaaacactgcatgttctcacttataagtgggagctgaagaatgagaacacacggacacagtgaggggaacaacacacactggggcctatcgggggacctgggcagggggagggacagtaaacaacctaatgcatgctgggcttactacttatgcaatgggtcaataggtgcagcaaaccaccatgacacatgtttacccgtgtaacaaacctgcacaccctgcgcatataccccagaacttaaaataaaacttaaaaaaggaagatgtttgggcaggtgtgactgaaactgcagatgtgtgcagaggcagggagtggatgagtgtggccccagctgaccatccacctcatcacttgttgtcacctctggcactcttattaaatcactctcagtttctaaatgtgcagagctccctcttgttctttttttgtttttgcactggctattccctgtgcctggaatggtgttttccttcccttcatttggctaattgtcctccagaccccaaggtggatgccaccttctccagaaagctttccgtggccctctctcgctgcattagggccattaggaaagaggtctaacagacttccacagtttaacatggctgggaagatctcacaatcatggccaaaggcaaagaaggagcaaagtcacatgttgcaatggtggcaggcaagagagagcatgtacaggggagctcccatttctaaaaccatcagatctcatgaggcttattcactaccatgagaacagtataggggaaagcaccaccatgatccaattatctccaactggccctgcccttgacacgtggggattattacaatgcaaggtgagatttgggtagggataaagccaagccatttcaggaccattaaaaaattcactaatcagggtcttcttcataattccaaggtcaagggaaatgtgtaccttccctccacattgagggggtagctcaatgctacagaccccacggtcagctctacgttgatacaaagatgagaacttggactttggtcccagggaaaggtggacacgcggatgaccacctgaccactatgtagaacaaagcaagtctgtgagagaggagtactgtttgtgggaggcagagatggggacagctgattctagtggctggcaggagagagggcctctcaagaggcccctgctcgctgggttttgcaggatgacaacagtcagggaatgtagaaaaaggaggttgggaggaagaaacagcaaaggcagaggctgggaggtgggacccgcattgtgggatcctggaatgggatgtggagtcacagtgggatcctctaccttttgtgtgtgcaagaatcacatccagcgagtctgataaacaatgaagattcttggggaaccacctgcttcaagattcagatcttgaggtctggaatggggctgagaagtctcatttaacaaacacccaacacgcttgttaattccaatgtgctgtctattgggcttagctgctctgtgaggtggaggggtggatgggtggagataaagagcctggagccaggtcatacggacctggcacgtcaccatcctgggaggtctaaaccctgcagagggaaatcagggagtcaacactgaatatcgagggggagacattcgagaattcttacaaaagagttgctgaatgtttattaaagccaattttgtatgcacccgggtatacaaaagagtctgaaattatacatgtcgtgtaggtttcagaatcttggttcaacagggattggccagggcagggatgagaatttgcatttctaacaagtgccttcccagctggtgccagttctgctggtcctgggaacacgttttgagaactctggttgttatttaaaggagttcaggcattaacctgtgagggactctgaagtggcaggaagaatgcaaaggtgacaacctctaaacttcttttctcctatttcccttcaaaggaaattcatcatgcaatggccttcaacccatctgaacattttctctggctacagaaaatgcctgggtcgtgccccgaaatgaatcttcttttcaaagagaaacggtaggatttacaggtcagtggaggataaggacgatgttgctgggtggctggggcttaaaatcactttaaaatagatgagtacatttcttctaatattcttgataaaaatcaaaagttcttctcttcctggacttgaatgaagtccagagagttctaagtcaaaaagttcacagaaaacaagtgctttcaaacacttagggtctggatgagaaaaatatgaggctgcaaaggactgttttgctcaaattcctataccagactctaacctttggggacagccctcttgcctctccatcaacaagtcaggacgttggtcctaccacagagaaattatgggctgcaaaaccaggaagctcaagtcccactgcctccctgctgcagacattcggagtaattatcaccccgctctgagactgagcttttcatctgtaaaatagaaatttcataacatcttttctaagtactgccacatgacataaatgacgcgatgactgacatcaatttggcaccagttccaggcactgttccaagtgctgaacatgtattctctttcttaagccttacaaaatccccacgaaagaggtcccattattaatgctattgtataggtaacaaattaggcttggagaggttagcaacttgcccaaagtcccacagcaagtgtgtgtgtgagaggtgtggggagctgtgatgcagatccaggcagtcgggcacgagggcccaggtgcccactacacagccctgcagaggctgttttgggcctttccctttgaagctcatttctctctgatagaatcacacattatcacccttttttaatctcatgggaaatttttctgtattttacggattaaccataattattgtgatataataaaaatcacttgtaattttggatctgttttttaccattataaaatggtaagtgctaagaaagagctgccatccttaagcaaacatggaatattaacaaaagatgatcacaaactgaccacagaataaactatcatatgttccccaaagaagaaacttatggatgacctttctttatgtaataaaacaaaactggtaatgaatgaggataacaaaatcccatctacaaaatcccaaaatcccaattgaaaacattgttctaaataattaatctgtattcatttgtgtgttgtttatggtatctgtttttacatttgattcttaaaatcatttcagttattttttaaatggtgtaaatttatatagttgtatgctaacaaatttgaaagtttcgatgacataagtgactttattgaaaagacagaaattaatgacatcaactcaaaagaaaataaaaatagatttttacgaaagtagttaaaagatattcaaagcatttttttccccaaaagactacagggtgagatggttttactagtgaggtcttttaatactttgattatcaactaacgaaatgtgagaaattacatttctgtctctgctgtggttacttgttacagcatcaacaggaaacaaatatacttataagaaattctcatctattatttttgcctatcaaataccaaagcctcatttaaatgcttgtggatgacatgggcagagtgagactaatgcccttgtgccctgccagcgggaatggaaattgaagcagactatccgaaaaaaaattgctcatatgtacgaaagccttaaaaaaatttacactctttaacctgttatttctatttctgaaacactaaactacatgaataattacagatttgaataatgattaatgtagaagattattcatctgaagtttacaaatcacactttttcagtaataaacacactggaggctgggtgaagtggctcacatctgtaatcccagcactctgatgggccaaggtgggtggatcacctgaggtcaggagttcgagaccagcctggccaacatggtgaaactccatctctaccaaaaatacaaaaattagccaggtgtggtggtggatgcctgtagtcccagctactcgagcggctgaggcaggagaattgctagaacctgggaggcgggggttgagagccaaggtcgagccctgcactccagccttggcgatggagtaagactgtgtcgctaaataaacaaacaaacactggaaacaatccaaatgtccaggaaataaaagaaaaatgaaacaaattataactcataaatagaaactagtacaattattaaaacatggtgtaatgtaagcattgctttagtcttttttcctacccttttcccattttttcctaagctattcattaaaccaaacatttcctctgttgatttttgaggtttccttttgcacacattaaaatcatacatagaaatgaattttctgcttctggccatcccttagtgcctttgatctttccattcttgtgcccatgctgcattgttttaattgttgtcactttattacatgtttaatgtactcactagcgtccattttcaaaactatgtcagaaacatacacttgcttattctcttgtgggaactttagaactctttcctcattttccatcacaaacagaaatgtcattgaacttttgattgaaattgtattgaatgaatacattagtttgaatacaattgagattgttttttaaaattcattattatcattataaaattagtaaaactatcacagcaaataattttaatgacttgttcacaacatcaggttgcaaaataatcagaatacaaaaagttataaatggaatgaaccaaattatgtgcttcttaaattttataaaagactaaatatcattgggcctcttaatacacactaaaattatgttatgttgaaacatgtttataaaactaaaaaaggatttcatctataaaatatttgtatgtgatagtttaaaatttctttctagattttcactaaaaattaagattaataagagttgagcattctgatttctgcatataattctttatgtaaaatgtaccaaaaaagtaagaactgtttttaattaaaaaattataagacaaaatatgtacttcatttaaaaataatttttttaaattaaaaggttattaaaagttgtgtcaaaatatggatttagaaagaaaatataaacaaaaagaatccagtaaatagaaagagatataaagaaagttatgggaataaagatatatttctggtaagaaagatttaagaaaagaaaataactttacattaaaaaatcttgcctggtaaatgttttttcctaaaataaagtgactggttatttaaaaataagaaagtatagaacaaaacaaaagttataagcatgccatgaaagttacgaaagtctgtgtaagttgtaaaaggtctgaaaatgataaatttacaaaagaaattttgtatgtgatcaagttgactatatttaaaagggaattatttataagcctttctaaggtttgagttttgatattaaaaatacaccaatacaaaactaaaaatttggtcccttatgttaaagcaacaaagttttcttgaagtaatgatctgcttttagtaaaatttacaagaagttctgatttttaattgtaaaaattttcagccactttctaaactgtagcttatttttttgtttgttttatagtctccatttaatttaactagtttttagtttaaaatgctatcttcttcttaaaaatggtatcttcatttctcaaggtggagttttcgtcttgaagcttctcagagtcctatctcagaagttcaattttaatgtgtctcacagcatagcatgtgcagttcatactacattgccttctgttctttcactttctttccttgagaaggtacatctttttgcttggctggaatgttgactttctccttcaacttctttgttagctcctataacttcttcctctcattctaacagctattgaggcctgacactaaaaatgtttgtctcaaagacctagaaaagcaatgtttctttttttccagtataacttgattctgtacttagcttttcttcatgtgtctacattgttccatgtaaccagggaatttctcatgcttttactaagagccatatatccccctgcttaaagtaatacttttcttgtttatgttccacagtgtacagtcatagccttggatatacattctgaatacatacaagtactttttcatcaggttgtctaaacaggcttcccatgaggtgaaccaatcacatagaaggaggtttttcattgcctttttagtaactggcctaagaaacaaatattttatattttatcaagataatttcctgtgttgcctttactaaatttttttattacttttaaaaaatggagactttaagggttaaagtttttttaatatctatataactttctgtattgcttttaagatctataattatcactctaattaaataaatgactatcacacagtgccctgtgatactgttttgatcaggtattttaaaacttttggcatctttgatggacttccccagcatcaaaatgctaaattaaatctttttgacataaacttaactttgagattttccagtcaggcccctagaaagcctcaaaggacttctctctcatcttgtagagatattaaataattaggcttatttggtaaattatatgggaaatatcaaatgctaagtgatactagatcttctttcagttacatttatggatatgttattggtatatatgttctaaaatggtaataaaactcttaaaatcttctatgttatcagtcataattttggttattatattgtaggccacaaaataactaaatttccttgcaaatttctggttatggggaacttttatcctattttcaactatggtagttttaaatttttgtcatttacagttattttaaatttttctctaaagttatctgcaattagattcattacaaagactttgacaaatactcttaaatacaagtttcaaaaaactttaagatcaatgtggtttttttcccccaagatggcagattagaggcattgttagcatgcctcttgtattagtcccttttgatgctgctgataaagacatacctgagactgggtaatttataaagaaaaagaggtttaatagactcacagttccccatggctggggaggcttcacaatcatggcagaagatgaaggcatgtcttacatggcggcaggcaagagacagcatgtgcaggggaactctcctttgtaaaaccatcagatctcataagacttattcactatcatgagaacagtatgggaaaaatccacccccatgattcaattatttgccactgggttcttcccacaacacatgggaattatgggagctacaattcaagatgagatctgggtggagatgaagccaaaccatatcacctctcatacttggaaagacaaaatagtgtgtagagactcacgctataattttttttccaagaaacaccacaggcatttaaccagaaaactgaaagaaaccacagactctttgaaagaagtggtggcagcagcctacaccataagccaggtggaaaactgtgagtcctcagagtgtggcagtgggagagactgcctctgtgacacacactcccgctagggaacctgataatataggccatgggggatggccttggccccacccagcactggagctgagtggtggggaatgttgagaaggagcagcatcggacatgctttgcgtgcactcctagactccagtggggatggagagaagacattcctgactctacttcacagggagccttgcagaagtcagccagccaactcgggtggcagtcacaggttgagagaaggtctcaactgtgattcacgacataatcttgagtggggatgagctcccttggccagaactaaggggcaagtgggggtactgtagtcacaagtacagaagctgggcatccctgctttggggtggaccaggaggggcacagcctgaaaaccacagtttctgtctgggtggggaaagcttatagcctgtggcagttttgagttctcagtgcaaggttcctggaacccagctagctgggttaaacaaacaaaaagagtttgtgctgttgctaatactacatgctatacttggataaattcccctagaagagttaagactcaaagacacaaaattaaaaaaaaaaatgcaggttacaatgagggaagaaagagacctctcatattgttttatactcagtacctgttttaagaaaaaaacaaggaagtgaaaccaaaggcaggcagcccagcgccaggcgccagacccaaaaccggacccaaaaccaggcctgggcctgcctggcctaaacctagtagttaaaattccacccctgacctagcaactgatgttatctatagattccagacattatatagaaggacattgtgaaacctcccattctgttctgtttcactctgaccaccggtacatgcagcccccgtcatgtaccgcctgcttggtcaaatcaatcacgaccctttcatgtaaaatctttagtgttgtgagcccctaaaaaggacagaaattgtgcactcagggagctcggattttaagacagtagcttgccgatgctcccagctgaataaagcccttccttctacaattcattgtgtgagaggttttgtctgtggctcatcctgctacaacaacaagtttcacctaatttgtcatgatcatttaattaatttaatttatttaatttatttaattggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaacttaaacttaacacttgattttaggtagatgtagcctgagaaccactctctccaaacccctcttgttgctcaaatgtagctaaaagagtttagacactaactccaattacaccttccaatgtaggaccaaccaacaacgtgagacaggttgatcccagctgcctcacctagggataatcaaaacctaactacaaaatggttaaccagtgatttttttaaaaaatcttgatcaaaaaaggaaatgtgaaagttgtcagaataaaaataaagtcacctgtgttaaaaagcaaaaataaaagcaaacccctgaaaaataaagctaaggaaggtcatgaaaggaagattctcatatacagatgcctgctggcaaaaactattgcaaaagactgcaaaaaccttgcacaaaggccactacaaccttacacgagaaaatactgctgcgagaacacctgcctagcaactgcctgtccaaccttggactgatgccacccttgttactgatccttctattcaaagataactatctcaaaaacaattacataattcgtctcattttttctttaaaatcctttgtcttctttcacctccctgaatatgcacatggtttactatggcacacctatgccaattgcaatgcccattcctgaataaacattgttttctttcagaaagtctccctgtttgttatttagattgaaaaaatttgcaaccattagtatatttctttccttgagaggaaagaaaagtgggagctcaaagttaatcattcttatctgacataaatgttcttctgagcatataaaatcgttcctttacggcctcacatcattcctaatctctcttctcatacttttgcctataattttcatctaagtctatttcttctttatctttgcaagagaaatagctaattgatttgttttaaaaaaaatatatcatttggagtcacataaatgttcagccatgacaattgttttatgatgtatctttgattaaattcatggaaccagcattaattcctacatttatttccctttcttgccttctagcagcctactctaaaagccaccttcgtctaccacaggctcagccataaagcaagtctcagtagattcaaaagaattaaactcataccaaccatactctcagaccacagtggactaaaattagaaatcaacaccaagaagatctctcaaaaccacacaattacatggaaattaaatgacctgctcctgaatgacttttgggtaaacaatgaaattaaggcagagatcacaaattatttgaaataagtgaaaacagagacataacataccaaaatctctgagatgcagcaaaagcagtggtaagaagaatgtttagagtgctaaatgcctacctcaaaaagttagaaagatctcatattaataatcttatcaccactcctagaggaagtagaaaaacaagatcaaaccaactccaaagttagcaaaagaaaagaaacagctataaaatcagaacagaacagaacaaaattgagatccaaaatccatacaaagaatcaatgaaaccaaaagttcattatttgaaaggataaatgagattaatagaccactagctagattaaaaaagaaagagagacgatccaaataagcacaatcagaaatgatgaaggtgacattataactgattccacagaaatataaaatatcttcagagactattatgaacacttctaggcacacaaactagaaaatctagaggaaatgaataagttcctggaaactcacaatttcccaagattcaattaggaagaaactgaaaccctgaacagaacaatatcaagatctgaaattgaaggagtaataaaaaacctaccaaccaataaaagccctgaaaagatggattcacagccaaattctattagatgtacaaagaagagctggtaccaatcctgctgaaactattccaaaaaattgaggagggactcctctctaatttgttctttgaaatcagcataacaccaataccaaaacctggcaaagatacaataaaaagaaaatgtggcacatatacaccatggaatactatgcagccatgaaaaatgaagagttcatgtcctttgtagggacatggatgaagctggaagccatcattctcagcaaactatcgcaaggacaaaaaaccaaacaccgcatgttctcactcataggtgggaattgaacaatgagaacacatggacacaggaaggggaacatcacacactggggcctgttgtggggtggggggaggggggagggatagcattaggaggtatacttaatgttaaatgacaagttaatgggtgcaacacaccaatatggcacatgtatacatatgtaactaacctgcacgttgtgcacatgtaccctaaaacttaaagtattaaaaaaaaaaaaaacagaaaactagaaaccaatatccctgatgaacatagatgaaaaaatcctttacaaattaccagcaaaccgaatccagtagtatatcaaaagtcaattcaccatgatcaagtaggcttccttcctgggatgcaaggttagtttaacatatgcaaatcaatataggtgattcaccacaatagatgcagaaaaatgttttgataaaatccaacaagccttaatgataaaacctctcaagaaactaagcattaaacaatcatacctcaaaataatgagagccaactatgacaaacccacagccaacatcatactgaacaggcaaaagctgaaagcattcctcttgagaactgaaacaagacaaggtgcccactctcaccactcctattcagcatagcaataaagttctagccagagcaatcaggcaagagaaagaaataaaaggtattcaaataggaaaagaagtcaaactatctctcttcactgatgatctagaaaagactccaccaaaagtctcctggaactgacaggggatttcaggaaagtttcaggatacaaaatcagtgtacaaaaatcagtagtatttctatacaccaataatgttcaagctgagagccaaagcaagaatgcaatcccatttataatagctgccaaaaaaaaaaactaggaaataattaaccaaggaggtgaaagatttaaataaagaaaactacaaaacattactgaaagaaatcacagatgacacaaatggaaaaacattctatgttcatggattagaacaatcaatatcattaaaatagcaatactgcccaaagcaatctacagattcaacactatttctatcaagctaccaatgtcattttccaccaaactagaaaaaaaaattctaaaattcatataaaaccaaaaaagagcccaaatagcccaagccatcctaagcaaaaagaacaaaagccagaggcatcatattacctgacctcaagccatactgtaaacctacagtaaccaaaacagtatggtactggtacaaaaacagacacatagacaaatgaaacagaatggagaacacagaagtaaagctgtacacctacagccatctgatctttgacaaagttgacagaaataagcaatggggaaaggacttcctattcaataaatggtgctgggatagttggtttgccatatgcagaagaatgtaactggacccctacattttaccatatacaaaaattaactcaagatggattaaagatttaaatgaaagacctcaaactataagaatcctacgagaaaacctaggaaatatcattctggacattggccttgggaaagaaaattgcaaaagaaattgtaacaaaaacaaaaattgacaagtggaatctaattaaactgaagagcttctgtagagctcttcaattcaagcaactatcaatggagtaaacagacaacctatggaatgggacaaaataattgtaaactatcatctgacaaagggctaaaatccataatctataaggaacttaaacaattgaacaagcaaaaaacaaataaccccattaaaaaatgggaaaaggacatgaacagacacttctcaaaagaagacatacaagtggccaacaaacatattaaaaaatgctcaacatcactaatcatcagagagacgccaatccaaaccacaatgagataccatctcacaccagtcagaagggctgtgattaaaaagtcagaaaacaacagatgctaatgaggctgcagagaaaagggaacacttatgcactgttggtgggaatgtaaattagttcagccactatggaaagcagtatggaaatttctcaaagaacttagaactaccatttgacccagcaatcccattattgggtatatatccaaagaaaataaattattctaccaaaaagagtgatgcactcatatgttcatggcaccactattcacaatagcaaagacatgaaattaacttaagtgtccatcaatggtggactggataaagaaaatgtgatacacatacaccgtagaatactatgcagccatgagaagaagcaaaatcatgttgttcgcagcaacatagatggagctggaggccattatcctaagtgaaataacacaggaacagaaaaccaaacactgcatgttctcacttataagtgggaattaaacaatgggttctcatggacataaagatggcaacactagacactggagacagtgggatagatggaggggagggatagaggggagaaaagttgaaaaactattgggtagtatgttcagtacttgtgtgatgggataaattataccccaaacttgagtatctctcaatatacccaggaaataagtacgcacacgtaccctcttaatttaaaataaaagttgaagtcataaaataaataaatagctaccttcttgctaaccctccttcaccctctgtgtttcaaagcaattgccttcattgaagcccagtttttctctctcttttttcaaagcttcgttgtctcagtctttgaaggtaaatgggaaatatgattaaaatagtgaaaatgaaattctgacacttagtgaaataactgtgaatttcacttggctggaacactgcaaatccccagagacatgaataaaaatttcccatttgatgttctttcctggaccagaagccctagatccacattcccagagcatacatttgaaaacagaaggatatttacagggttcctcacccatcttcctggccagggccaagactgtctggaaactcccatctgatgggaagagacagcctataggaaccaatggtacaccttttggctagctcaaagccagaaggtgggcatgggcagctgtgccccttggctggcatcatgttcatgagccctgttcctgggagagagtgtcccagcctcagaatctaggtacccaggtcctcgaatcagctcttccttccagttgctctgagacatgcacagttcacatcagtgaacttgtcaccttttcccctgcagagctactccttctctttcatagctccctgtcttagcatctggtaccaccattctatctggctgatgtgccagacgcctgagagttatttttgactcctcctctctgggacaccacatcccatcaccactaacctcactcaacctcatctgcctctctccatccacactgccattactctgacccaactcataactggaccagtcaaccccttcagtcctggctgggatccaatcctttctccatgctgcaggccaaaagccttcttgaagcactcatcatgtcctcaatgatgtcccattgctttggggtacaaataagccttcacagttacacagtccccatcaaggtgtgtgaaaggtggccctaaggctagacccagcccacaggtgggacgttttttgttttttaaaggtcagtttccaatatttacaaattatgaaatatgacaaatctggatttgtaatgtctcttgaaaatcagaaaatctgtcatctctaggccagtgtctgtgatggaaacagtaggagatgcccttgtccctcaagcagccacaggtcctgggaacctctcaccttgcccatccttccctgtgctcatttacagcataggtgtggccctctctgctgcctgccttgccagcggtctctccctctccctctccccctccccctccccctccccctgctcctgacacctgagtttttctgcctctgaacaaatgccagggccttcccccatactcttacctctggctagaactccccgcccccattgcctctctcttcctacagacccgcccagataaatcctactcatcctcaagccatgagtttagatgtcactgctgcaggaaaaccacccccgatgccctaccagaggtcagtgcctattttcctattacctgtggccattggtcaattgccctcctgtgacctccgaagggcagggctagcctgatgatctcaccactctaccaccagcagccaacccaatacctggcacaatacctagcacacaatagaagctttctacacatttgttgaatgactggataaacttgacgcctctgggttagtgtgcacgcaagtaagatgccatcgactggcgggacaagatgcggaagcaaacggaaatcagtgtgggagaggcacaggtgcacggtgtcctaggatatgctgaacagtcactatttgccagcgatgttttcccagaggaagtcaagcttgagtggggcttgggaatttgggacttgcaaccattcctgttactgaagaggacactgggtcagagaggtgagtcgaccttcccaaggtcacaaagtccttgcagtctgagtaagaaagacgtgggctgtacctgatgtgctcaaagctgtagctccagaatcaactcaatgttttaacaaatgtggtgaatgaataaataaagggtgaagacagaggttgaagacagaccttacggactcaagcaggagaaagaacttgatattgatttataaacaaagtggaatttggaaatgatccccaaagagaaaagtttagctctactgaggtaaatatttatttactttttttactcctaaaggacaatagcactcttcattgacttttaaatgtatttttgtttagggagctgaggctgttatcttgtttttattatcaacatgtggtggttattttgagaattttaaaatatctttagaaacaaaaagcaaaagagtctctttagtttggaacctcacttaggttgagagactgtttctaacacactcgcaattaattatagaaatcgtcatgcatatgacaaccacaaatgtaaaatgtgagttgtttctgtttttgcaaaagaagaaactaaagtcatagccgtaataacccagaatggtcataataaaagatcagaagcagatgcctctgaggtgacctcgattggctgaaatataaaaagtcacttataatatcacagaaaagtacacttaagaatggtcaaaatggtaaactttatgtggattttaccacaataaaaaatgttcaaaacatttaaaatttgctttaaaaatggaatacagtgattcctccacttataaaaccttccactgaatgagaaaggagctggccctagagtcagtgaggctcagtagctgggacagaaaggaccctgtgggcagaattagccccttctctccagagcgcccacattcccagaaacaccagtgtgatccatccttggatgtgtaagacacaacccatacgtggctttgaaagcacacagacccgggttctggtttcagcaccaatatgcccttgtttgtgagagctctgtcccttacctctctctgcttgcgtccaaggctgcatatctgagctactcacaaagtagctgttaggatttgagcagcataacaaatgagtcttttacataactgctctaggacgtgcgaatttgttatgtttgccccctgctgctagaattcagctccacagggagctgtttgtctgttgtgcactgttcgtgcctagaacagtctggcatgaagtgggcattcgaccatcattagtggtttaatctctgcctaccctcctgccctgcctgtgtgagtgggaaggcagcgcccctgcatccctgggaggcatcccctgggaggaatcctagcaagtccagtggcctctttatccccatgtctaccacctcagtcgcagctgcatccttcccttaccatgtgtaccaatagcagcagccctctgcctctctcctccccacccttcccactctagtctacacccaccgcctccaccccagagccaccttctaacactgatctggccatgtcaccctccagctccagtgccatccagggcttcctattcccccagggtgaagtctgtggtggctcagtgaacagacgcttcatctctcaccctccccatgcctgctttctcctcagccccacagccatctgagttctttcccagggctgtgccccatcttgagccttttctttactgatttcctttctctggtatatcctctgtcccaatccccatcatcacctgcctaactcctgcttacccttcaggagtccatttagaggccacctcttctaaaaagccttccttgagtttaccccaccccattcgacctgagtgaaatgtttcttttctccctgctaaggccacacagcaagtaaatcatcgaactgggattcaaattcaggcccacctgctcccaaaacagcaagccaaaaccggaagactctacttacttatctattcaggaaaaaagagactaaagaatgaggtagagctaagctaacgtcttgaaaagatgcccaaaatatattaaatgaaaacaccaggttgtagaacaatgtgtatggcataattccatcaaagccacaataaactatatatgtttatataggtttttaaagcacagaagatgcctaaacaaacacaaattgagctattaatgataattactgggtgggtggacttaaacattctataaggtttcaatttgttatgtattctttatgtacttaaaaaaaataaactcaaaggaactccacaacttttctccaataataagtaagaggcttgaataccagaaattgcaaaatacagggaccagcttttggagaaaaggctccttcctgcagtggtaacatgagatgagagcagatgcggttgaccagggagccacactcacctttcccagcagctcgggcaggcccagaagctgcccagtgaacacgccaatgcagataaagatggcagtcacctgccccagagagccacggatctccttgggtgagatctcactaaggtacatggggagcacactgagggcgacgcctgtagagagaaagcatagcagcagttagagaggtgtcttcccgggggagctgcactctggttacaatgcctctcttggctctgctttgccctggacattaaatagcactgtagccacggcatttttcccagcacttagcacaaattgccaaagctttcccatgaactttataatttaatcctaaagtatgactggaggtgcatttcagaggacaggacacagctgatggtgttggtggaggtgatggtattgatggtgataatgacggtgatggtgataacggtggtcgtgatggtagtgatggtggtggtgatagtgatggtcatgatggtgatgatgatggtagtagtgatggtagtaatggtgatggtggtagtggtagtgatggtaatgatggcgatggtgacggtgatgatggtggtggtaatggtagtgatggtggtggtggtagtgatggtcatgatggtgatgatgatgatggtggtggtgatgactgtgatgatggttgtggcaatgatgatgatggtgatagtggtggtggtagtagtaatggttatgatagtgatggtggcgatggtggtgatagtgatggtgtggtggtggtggtgatggtgatggtggtgatggtggtcacaatgataatagccaatacacatagtggctaccaagtaacaggaatccttctcatctctttatatgtattaacgttatttacttttaacaatagtcttctgaattaaatatactattaccatttctcttctaaagattagtaaactgaggcacagaaaagttgagtaacttgcctaaatcaccaagtaatgtccagagatgtttaaaaaaattattttgcccaatagagccccagtgggtctctgatcttagaacttgcacttttcccaccagctaacattgcctcttgtcataaattatgggactccgttatggcagatgctattatactcattttataaaaatataatagtttttttctctaaaccttctagatgaagaacactccaggaagatgccctgttgtcctattatggtttcaaatactccgggagaacctggctggattagcaagtcttagagccttctatcatctcaaaatccttcaggtttatcatttggctttaaattcttttttttttttttccaagatggggtttcactcttgttgcccaggctggagcacaatggcttgatctcggctcaccacaacttccacctcccgggttcaagtgattctcctgcctcagcctcctgagtagctgggattataggcatgcgccaccacgcccagctaatttttgtatttttagtagagacgggtttctccatgttggtcagctggtctcgaactcccgacctcagatgatccgcctgccttggcctcccaaagtgttaggattacaggcgtgagccactgcgcccggaccggctttaaattctttattacaaacagatcggccagttcaggtaatagcagcaatattcctttctttctgaccaattgtctcaccttaagtgccctcgagttcttctctctgctttgagagggttggtgagaatacatgacatgaagtctccaagtcctggcgtgactccaacaggccacgtgccacaagtcggaaagaccgaagttttttctttccttcttgttcttctttctttcctgcttctttttgaaagctcataggaaaaagggtctaaaagacatttgttctatctctgtggttttgtaaaaggtccatcttggaatgcagcttatttttagttaaggaaattcagagatcaattagttatatgttcgaagggtcaactccccagattagtcaaagcaacaagaaaggggataatggataaaatataaaactgccaaacagagaatctcagttgcctccactaggaaaggacttcccagaagatccactgcaacctcatccaggctttctccaaagcaggcagggcctctgaaacccaaatcctagatctgtactttattaattaagaacacaaataacaacaatgacaataataccatcagcattcctggagtggggcactaagtgcctggaactacactaagtacttcaatacgtagaacatcgtttattttatttatttatttatgtatttacttttgagatcgagttttgctaacgttgcccagacgggagtgcaatgggtgatctcggctcaccgcaacctccatctcctgggttcaagtggttctcccacctcagcctcccgagtagctgggattacaggtatatgccaccatgcccagctaattttgtattttcagtagagacagggtttctccatgttggtcaggctgctctcaaactcctgacctcaggtgatccgcccgcctcggcctcccaaagtgctgggattacaggtgtgagccaccgtgcccggcccatttaattttcacatcacccaacaagggaggccttactgctaagttgccacgccaggtgggaaagaggccaagactgtgaggtcaatggttgctgcagtggtccctgatttgtaccccctccctggatcgacatccttggggagttagtcctctctgacatttattctgcacgtggccatgggacttgcttgggccaaagggacaccagcaaacgtgcatgcaaagtgcttgcacattgtgcacattgggactttctcctttggctgctgttggaagcccaagaactttatgcaaggcagcccaggcccccctggcccagggtgggaagccaagaaatgagctggcccactgacagcccgtgagaccaggccacctgctaacacccaaacacaggcgtgagaccatcccaggtcatccagccactgaccaacctgaagccaccgcagacacatgagaaggcccagcagagattggcagagctggcccagagcagaactgcccagccgacccacagaagtgaaagcacaggaaaatggttactatttgaagccattaagttttgttttgttttttaagagacagggtttcgctctgtagccaaggctaaaatgcagtggtgccatcatggcttaagtttcggggtttttaaatacatcaaacctaacctatacagataaattaatgaaattaatggaagcaagtgagagcattcaggcagtctgactccatagtcttcacccttaaccactttcctgctccagctttctgagcattagggcccccatttgtaaaatgaacatgagaaaacagtctttcattacaggaggagatcaaaaaaaatgaaaagcatgaacacagttggtcagttataaaacattacatagacaccagccattattcttatggataaactctcaatagccatcaatagaaggagtctattcaagtagtatagacaaatgaatagacaaatgattgaggagtcatttcatcttgagtttggactattagagaggcctagattattcccctccagcagggcaacaaaagtaagtgaagcctcctcttctcaaccttacttccaggcccccactctcctgctcacctctccctgagacatttttattgttcatctcactcagctgaacaacctggtaccctcagcttttaagacatcgacaaggaagggaattagcctttaagaagctcatgctaggttccaggcagtacatatgtgtatatgtgtgtgtgtgagagagacagagagagagagagagacagagtgtgtgtttccgttcagccttattatagccttttgaagtaggtattattaccaccattttacaaatgggaaaaccaaggctcagagccattaagtaacttgcagcagaactgagatccaaactcagggatttctaatcctaaggcttgcaatctttccacaaatgcctaaaagtgatactttatggatttgcctatttagaaagagagcagcgtttgtctgacaatatatcttgagtctcctactctcactcccatagccagcatctgtccccttctctgcagctccccacctagcccagtcccttcccctgaacagctggctcctctgattccactcctggcttcccctcatactccattactggaacaaaccagtccatgtcacattcatctcaaccctccctgcatactcggcacaggcacacagtcctcgccgtggcctacaaggtcttatgtgatctggccccagctcctctttggcgtcatcagcacccacacatctccttgctctttcccagacgtgccatgcctccttccgcctctgagacataatactcttctctctgctgggaacagttctcacccttggctcctctggtctctgctcaggtttccttctctgagcagtcttccctgattggcctttctaaaacagccctcaccaccctcctgtcctgctttgttttcttcctaggacatgctactgtctaccttatgtatctgtctgcccactagaatgtaagctccagggacagggtcttgttaatcattgtgtctccatcctatagtgtgccagccctcgcaggtgctctacaaatgcctggcgagtaaatgaaataacgaatgagtcagaggcccagagaagaaaccccatcctcataaaagccccatgaaaaccacaaataaccttggaatattaacattatgatgaaggtgaccaaacagaaggcatgacatgctgaagaccatccaggtctttggggtagactgcggaccctgcccagcattcctcaattaggggctagagcatcatgaatgggatggttcatcccacaggactgtcccactttatgcagagttccagcatccttggtccctgccaagtcaatgccagcagagagccccagtcatgtgacagccccaaacacttctcacattttgggacacccccaaggagtatgttactgttccctccccgtcatggtgaactctcacctccatctatgcccatgatgaagcgtcccacgatgagcatttcaaaggctcctgcctggagcgagcaggccatcagcaatgcagcagaaattgcaaacccattattggccagcaaagtgtgcttcctggaaagaaaggaaagatttgatgaagatgtctaaccatgaggcatgtcactgaactgtccatcccaggagcaggagccaggcccttctgaagggtgagtagagcaagactcaggcacagtgcagggagcactggccttgccacctctggctgtgtgactgggttcagccctggggtctactaggtcacttacaaaggcaccatcagccttgacatctatgaattctctgtggtagtattttattgctttaattctaagactatcatttaacatttctgaagtcagtggtcatcttacaattcgtgagtcagggtccaggcaggaaaatggaaaccactctaggtattttaatggagagaatttaacatagggaattggttaagtggatattgaagaaccgagatgtcaaaaaggaagacctctgaagaaggggtgtttcccatgtggtgctgacacctcaggggcatggaggagggccccgaagacctttgagagtgggcactgtccactggactgtttcctctgaggagcaatatgattctggttctggaaatggacaaaagttggaagctggaatcaactgccaatgtcatcactgggactggcaggaaactcagacaaacatgaaaaagctagtcttttctctctcctctagtgcccctattggcaaaggacaaatgggggtgcaggccccagccccagcatcagagagagagagcccagaagggtaagtgtggagctaggagacaacagcttgacaaccagcatagcgttctacaacttttgttggctccttccctccctccctccctttcttccttatttcctttcctttccagtggctcataaaataacaatactcctcagacccaatggcatcttagatttgatgaactacagtactaagtgaatggctggactaatcctctcaaacaagattagggaaatttccatggcaataattattattaacagctctgtgtcaggactgccatcacttttataaacacatgcctaagacctcatggttcaaatacctgacttgtttggaggcctggggacctggattcctgcaccagctctatccttcaggagctaggagactttgaacttcatttctctgtgttttcttttcctcacttttgcaaaatgatcctaaaagcccacatttattgaactcttgctataggatagaccctgctttaagtactttgcattagtagctcatttaatcctcagaatgacccaaagagataggtactcttataatctctattttataaacaagttaactaggttgctggcaagctagaaacttgttttatttttaatttttatttttgagacagagtcttgctctatcacccaggctggagtggattggcacaatctctgctcactgcagtttccacttcccaggttcaagtgattctcctccctcagcttcctgggtagctgggattacaggcatgcaccaccacacccagctaatttttgtatttttagtagagacggggtttcaccatgttggccaggatggtctcaaacttctgacctcaggtgatctgcctgcctcagcctcccaaagtgctgggattacaggcgtgagccactgcgtccggcctagaaacttgttttaggtcatatagtcagtgagtcaaggagttggggaaacatcttagccctttacggcttattttttttcctatagactcaatgagttaacagatattaaattgttttgtaaattgtggttaaaaaattattttgcccaatagagccccagtgggtctctgatcttagaacttgcgctcttcccaccagctaacattgcctcttgtcataaattatgggactcagttatggcagatgctattatactcattatataaaaatataagtttttttctctaaaccagcctctcgggagactggggcaggagaactgcttgaacccaggaggcagagattgcagtgagccaagatcatgccaccgcactccaacctgggtgacagagcgagactccgtcttgaaaaaaaaagaaaagaaaaagaaagaaagaaacatcagtgaggccagcctggctggaggcagtagggagccagggagcaagcagtagaaagtgaaagttgagaagagaaaagaagaactcagagagtcttctatgccaccataagaactagcgtttcccccctgggggagatagcagccactgggagattccaaggagaggaatgacaccggctaatacttgaacaagatcactacatcttgtcttctctgttgctcctggactgcaggggacaagtgtgaaagcagggagaccagctggggagctaccacaacaggtgagtcaaccactggtaatgatttggaccaggctgggagcagtgcacttagtgagaagtggtcagatcctagcatattttgaagagtgagttggtgggatttgctgatggactggacagaggtggagaggcatagaggagccaaggatgcctccaaaagctttggtctgaacccttactttggacatgatggtgtattttgtgctaattttaaaactgcatgaaaggtttgtgagaatgttaaaattatatgaaagtctgacttgaaacatgtgcaaacgggagtgcacactctctgggcaagtttatcatattaatatattccttcccaaaataaccctcagcctgacagcattgcagtgaggatggaaatgtgtgcaaatcctttgcaaagctgactcactgggcttcagagcaggactttaatcattgtttccatttgtttcctgtggatgaacagcaacataaacaagggagatcaattctgaaagcagaactccagtgtccccagaactccacctaggatgcctgattcattgtttttagcttctccaatagtgtagaatcttccccatgaaacccagaaagtcatcagctctcaaggggaaaaaaagaccaaatacaaggaagcatggtagggtgatgaggagattggagggcatgtcccttcagaagtgtcaaaggggctggagacatttcgcctggacaagaggtcagagaaagcaggagagccaccttccttcatgccatgctttaacttggtgcagagcaccaggacggattgggggaagacatagggaattctatttcagtttgaatttggaaagtacttttcattaaaccctagtagaccagagaacctatggaaataatgtatctctccacagacctttccagtaaatcttcagcctgactgggcctataagccaagatcatgccttgtttccacatccctcaccctcctcgtgttcatccgttcctgcatacccagcttgaattccttggctcatccctttaaatatttatatgcccatccaccccctttcattacatatgcctggcaaaaccccagctggttaaatctctgtctactgggcatctacaaagctcagcttggctggagaaaaacatatggctgtgttgtcctttctcacctgaaattcatgaccaccaacctcaagaagggttaaggctcccctgcactgagtctacagattcctggtccatccaacacccttctctcctagaggactatttcatatgttttctctctctcttcaaatcccctttttatcattctcagctgatgaccatgctttctttttcactgagaacacagaggcaatcccaagagacccttcccacatgccctctgcttgtatttctgcacctgcatctgtgcccagacacctgccttcccttgttttccaaccctggtgcaaaccatgtcctctctcacctgcgctattgcaaggttctcccaaccaggctctgagaccccctgataacagcacacctttccaaatgcaagtcagatcagttcttaaaacgttccactgacttcccattttgctcagaggaagagtctcaaccctcgcctgcaaagtcctcaggatctgactccaaatatcccatctagcttcctatgattatctctacactgacctccactctcatcttcaaagaagtggagcctcttcttgcccctgggcttttgcacctgctgcctcctctgcttggagagctatttcccagggatgagcgtgctcactcccttgcttccttcagtgctccctgcacaagtcaccattttagagaatcctctgaacaaagtggtgagctcttcaccctccccagcatcttctgacctccttgagctgctctgttttctacattggtccttgtcacaggccgaatggcacagtctgcatgcttgttacttggctgtgctccccgcttggctgcatgcttcaggaggacagggactttggcagctttgctcatgcctgagtgcttggcacatagaaagtactcaacagatatgtggtgagtaaataatcggatgagggaacggaaagtgtgcaagcatacaaggatgcttagatgcaagcaaggatggccacactggggagatgtgatagaaaaattcaagcatcgagcattttccacccatccttccatttatccaacaaatgtctactgcttgcctgctgtgtacaagctgctgtgttgggtgctaggggccataaatacatatggttcttacgttgaagggctcccttatcagggaagagacgggaacataatgaaatgagtacaacccaaaatgccaagtgacgtaacacagggaactgaaagtcctgtgtgagctcagagaaggccaatatttagttctggtagatatgtcctaggcagtgggggatggggttgaagatttcttatgatttctaaccctgctttcccggctcatgcgtctgtaataccaaaggggttgtgtccataataaaacaaaccagtgatgcagggacagcttgtaccattgaagcctcttgttttggatgtgttgactctttgttttacactttggaaccctgccgtcccgaagtcttctggtcttatctaccatgcccaggctttctccttatgtcccatcatgaacccaagtttccttcttccagagttcttgccattctcactatgcttagaagactagtcaagtcttctaaggctgggagaagcagggttgaggatcaggtttcctggctggctggttatctccctatcccctcagggattcccccagctcaatgaatgctggcttctaaaggctcagggttgactcttctccagaagattgacattggctctgaaggtggatccccctttcccagtgctgcctgcagcgagtgacagatgagtggtaggggtggatgcagcccccttacttcaagttgggtgactctgtggtgtgattatgccccagagctcccccaagtgaggctaaacttgaccagggagtgcagccttgcctggctccttcccctgctgctttctgctttccccaccttaaagattactcctgaagagcccttcctccacaagccatgtgtgcatcccaatccctgcctcaggctctgcttctgggcaattgactttctgagacaattccagcctgaaagaagaggttgtcagcagcacggtgtgttgctcagtcatggactaaactatgttcctgccccctggttgagaacccttgaacgcatgtaacctcgctcgggccaaggagattcatgcctgggactttaactacaatgattggaaggagaatttccatcaagctggggccatcttgcacctccacagaagaaactgcctgacaatgaagccaacaaaaaacaagctgagctgagaggtggagaaagagagagatttggatttttttaaggctcacctgttaaagccctaacccctaatgtgactgcatttggggacagggcctttaaagagataattaaactaaaatgaggtcacaaggaagcggccctaatgtgggatgattggtgtccttgtaagaagaggaagggacaccagggatgcacacacacagggagcacacagcgagaaagcagccatctgcaagccatggagagaagcctcgggaggaaaagacctgccgacactttgatcttggccttccagcctccagaactgtgagaaaatgaatgtctgtttgctgaagccactccatctgtggtattctgatatggcagcctgggctaaccaatgcatgcttgccacatacactgaaggctcctccagcaggcacctagagagacacagttattttctactactataaaatacagatgccttttaaagggttgaagtagaaaatgatgaaagcaaaaatagtccttttgacaacctgctatttccctggagtgatgtatgggatgcctgttgtttgtgctcaccgaacctccatccttcttctgggaggagttcctcaaatttccaccaagaaaccttcctgcctgtctccacctaaccatggcttcaggagtggatgcgtggtacaggcctggccagtcaacataaaatcactcatcattctcaaggcatttaagatgtgcttttttaaaagcacttaatccagagtgttagaatgttatttgccaggattttctaaccttggcactattcacatttggaactggaaaattctttgctgtgggggttgtcccgtgcattgtaggatatttagaggcatccctggcttctcctagatgctagtagcacccttgagttatgaaaaccagaaacatctcctggcattgtcaaatgtcccctgatgaggcaacattgccctctggttgagaacccttgaacgcatgcaacctcgctcaagtcaaagagattcatgcctgggactttaatcacaactatcggaaggagaatttccaccaagctgggcccatcttatacctccatgggagagattgcctgacaatggagccaacacaaagcaaggtgagctgagaggtggagacagatttggattttttaaaagctatcatctgagccactggattcaaccaagttatattttagttattgtgagccaagtaattcccttttgggcttcagccagtttgctttgggttcctgtcacaggcattcaaaaagcctccttagtgacatgagacactgtaaatttgatctcgttccaccctcatagctgctccctcaggtgggtttgtttatctgcactttacagatttaaaaattaaagggcatagcagctgcctcttgtatctctaccatccatgcacagcactgctcagaatcataaagacttacataatgaattactcaggggctgcctcctttgcccaagcatcaccttaagccccagatgttgtgtctttcttgttcactgaagccccagtgccaaaaacagtaccttactccttgtaggtgctcaaaaatgtttgtttggatagatgaatatggttacgtggcttgtccaagagtctggcccaggatcagatttcaaagcccatgtgtgttttcctatagtttcttatatgttttttctgctttgctccagacggaagaaccagatccaatgatatgtgtaagaagaataatttcagtgcaattgaaagaacagatgcacaattgactctgtcaagtgatggaatgacccgtctcaaataaagccaatgaggttggtgatggtgaagatgatgatgatgttgatgatgatgacactagtgaacaaaggctgggcgaagagtctgggtcaattgtagggatgaacacttcacatccaccatttcatttaatcttcacaacaaccctctgacatggccattctttatcttcatgtcatcgtgaactaagtaaagatgaaagagtttaagaaacacatagctgtgtgtatcggagcccagacttgaagctgggcccgtagctagtgtttgtacaccaaacatagtcactgtcctgtctcatgagggaaggagggtcctgtcactatggtcatgcaagcagaggacagaggatgctaaatgggtcactgagcttcaaccagaattcttgatcgctgagaattccctcagccagagactccaagaggtgaggaacctgcatctgtgtgaggcccaggtcatgtggtatggcccatctccagagactcttcctggccccctttgcttccctgccctcctttgtcaccgaaatcacaaacgagctcaacattccctagctaggaacagccccactgctggagcagccagtgaccagccccatcggaactcttccccacttccctggaatgtctcccccagctatacctttgagcaccttccactgggcctcccaggctgccattgcagtttcctctccctccctgagaatccccatgggagaggaataacagagcatcaggaaggcgtttcaaatagcatcatgtcacaggaagagtgttggcctgtggtcaaacacatgcagatctgaacttcagttcaactccattttgaaaccttggtccaattgaccactgggtcttggactcatcatttgaaaagtgcaggtaatgatgcaaacatggagttttaagaagtaaatgatatatgggatgtcaaggacaaggcaggaggtcaatagatggtagctttctttttcaatttttgctccttttctccccagcagagttgctcttcaagctgaaacttcagcccaaatcaacttttactctcataatgatgaaaaggaaactggcagctgcttggggcataacaaccaacacatcctttgatctgatctttttctgcatcctcacttctttatgactcctccattacttagagattgaaggtattttcaaagttgttttctcttttgctttccttttccttttttttttttttttttgttgccatgccagtgagggtagtaaagctactttcattgccctcattttataggtaagaataatgctggctgagaagtgaggtgtcaaagtcccttgtaacacacctgatacacagcagagtcaggacttgctgagccacggcattctgacccgattctagtgttccttttcctattccatctgcatgggttcagagcctccttgaggagcagccttggggtataaatgccacggtcaggtataaagcaaggagacatcacaggccagatcctggggcatggggagtgactccatcccactaggacaagcaagaggaccatgggcagggtctggcttgggcaggaggcttagtgaccatgcctcagggaccctggccagtgatgccaatctgagtgccagcctgttgtcaaacagtcatggttttacagtacattcccagcattgggaattggcccctaactaagatctgcttggcatagtggaaagatcatgattccagcctaagctcagccacagtgcaagctagctaagcttgtgcagatgccctcacctctctaacctcccattccccatctacagaccccacagcagatagaaaattaaacaagagaatgtgtgagtggctggaaccttgaaggacctcagacaatggcatctctcactacatcatgcagtagttgtatttccaggccctgaattcccattaattactgctctgaaagtgggcttggggacaaggaaaatgtcagcacctcccctacctcacaggtatcacagaccctcataagcaccacttggatgttttcagggtggcttcctgtcccatcttttagaaatcttgctttgaaacatcgtcaactctagttttctccttgttgggctgtgaggaagaatgtaaaggattcggtcatttcagattgtgaaatgggctccttcttaatcgggtttctgtaatcccatggtctgaggagattttctggagtctgataaatctcctcttcaactcacgtcaatgcaataaggaggttagtcgagtacttactaggtagtgatgtcaaggtgatgatgagggaaatgccaaataatgtggtcaatgacaagaatttttatttattcagctacaactcatggccattctccttccattcatttggtctaactcttgtaacattccctgcaggtagaaactatcatccctattttacagataagaaaattgaggctcaaataaattaaatgatttggccaagggcacacagctagtaagtggaagacacatgattcaagttaagacacgaatgttctggccccatcagattgatgtgacgactcctccatcacttggagaagctctactctttccacacactgctcactggctcccaggatgctgttgttatgaacaagaatacagagaaagcattgtttgtggggattcattgataagtcaatctgctctgagagaaggattcctgtctaaaataagtgaggaatgaggctcacaaggtcaagtgagctgattggagagggcctgggtaggaaaggctgatatgaagtttttgattctcactgcttccttatttgtaatgtaaatgatctgaaatgacctaaatgtctctcagtcagggagtgtggctaaataaatgatgagacagccatatagtggaagactgtctaagcagtcaattttctggaaaagcagatctgtatgtacttacgtggaacaatttccaaggcactgcactgtgttttccatttgccccaacacccagatcaattcccctcccctccctgctctgctctatgccccgggagcatctcctggatggcaacatgacttcctggtttactggctttcacatgggtgtgaccagtgtgcacctctgcagcaggatggagggtgggaggagggaggggtcagggcatttcttccctgctcctcccccatgtgggtgctgtggctctgacacagcccagtccctatacgcttctgctgctgctcatcagcctgcagtccatggcttcagttatctttggaccttggtctctgatttcttcccctttcccctttgggcatttgaatctctccagttgaactgcctgagtggagttctgttgcctgtcaggaccctgacaatgacacagatatattatgaacatggagggcacccccagatagagacagcctcctactgacctcccaagaacctttccaatcatcttcacaattaacgtccccacaagtccaccgatggcgaatatggacacagtcacagaccagagcaaagtcagagtgtctgggtctattggacgtccatgccttctttcccatgactcattgtaaaaggccttgatgtactgaaaataaacaacaaaccatgttatttccttctgttctctcctgctgcttgaagcaagccagtgtacaaaacaaaacagcttgtacagagcattttcatgcatagcactttgctaatttgtttgagctttatctcattggcctcttctaacaaattttgggaagagcagaagatgttaatctttattatattcaaatgagcattttttttcttttatggctagtttttttgtgtttcttgcatctttgcctatcccaaggtactttttttgtaacaaaatgtttcctctttttacctcattttggagatagggaaactgaggctcagggagacaaagtgacttgctaggtaagtgctaaacctgggagctggactcagatctgaccccaagcttatgatgagcttcatagctgggcttctccaattctagtgcaccgcagcattgctgtggaggtgtgttaaagggcacataccgggtgggcgcagaggcccacacctgtaatcccagcactctgggaggctgagatgggtgggtcacttgaggccaggagttcgagatcagtctggccaagatggtgaaaccctgtctctactaaaaatacaaaaatttgccaggtgtggtggcatgcacctgtaatcccagctactcaggaggctgaggcatgagaatctcttggacccaggagacggaggttgcagtgagccaagattgcgccattgcactccagcctgggtgacagagtgacaccctgtctcaaaagaaaagtgggggggcacatacctaacaaaaaaaaaataggcaaaaatgcaacacacacaaaaaaactagccataaaagaaaaaaaaatgctcatttgaatataatcaagattaacatcttctgctcttccaaagacgtcattcagaaatgaaaagacaacccatagactgagataacatatttgcaacacatagaactacaaataaatcctatctacgatatacaaagaactctaacatgtcaaaaaggaggcaaatgatacaattaaaaatgagcaaaaatttgaacagactccagagaaaatacaaatgactggtatgctaatgacagaatgcctgacatcattagtcaacagagaaatgagaccacaaggaaatacaacttcacattcactagagtctcatcgctgccaattctgattcagtgtgtttgggacagggactaggtgattctgatgtacaccaaagactgaggtccatggcactaagctccaaacagagttcagtccccaaggtacttagagttccctgttgctacccaacgtgagcccgcaaacctcagctgagccagtatatgacactgcagaaaaagcttaggttcaggtcgctcagacctgggctcaaatcccagcacaacttggtaatgatttaaatcagctgaaccttggttttcttatctgcaaaatgggaatgatgacattgacctctcagggctgttgtgagggtcaaatgagagcttgaagcagtggccagtacttgaatggagcttacacaatcccacatagactaaaaattaaaagatctggtaagactgaggagtgacaagcagtgtgttgtctgctggtaggagtttgacttgtacagccatcttggaaaacagctttggcatcagctagtcaaatggaagatgcctgtagcctacaactcagcaaatctacttctagaaaactcccctgaaaaactgtttctggggagccctaggatatatgtactcagatgtccatggcagcattgcacataataactccagacgagaaacagcccaggtgcccatggtcgatagcaggaataaacaaattgcagaatcatcatcatatgaaacatcacagccacaaacatgaatgaatacagctctgtccaaacacacatgggaaaacctggcaaaaataacaccaaccaaaagcagccaaaaacaaaacatacacagtctgattccatgtgtaaaacccaaaagtatgccaaattaaaattttttggagaattatatatagacggtaaaactacaaagaaagaattatttcaaatgtcaggtcaggggtcatctcgggggatgacagaagaaataactggggagggacacttggtaggtccttctttttttttttttcaggctggagtgcagtggcatgatcacagctcactgcagatttgatcccctggggtcaggaggtcctggtacttcagcctcccgagtagctgagacagacgactacaggtatgtgccactatgcctggataaattttttttgtttgtttcttgtacaaaggaggtctcgccatgttccccaaggctggtctcaaactcctgggctcatgcgatcctcccgctgcagcctccccagaccttttattcttaacctggattgtgacatgagtgttagatttatactcagtctttaaagtgtgtgtgtgtgtgtacgggcacacaagcataatgcatatgtgtgtattttatatactcttttgtatgcataatacatgctgccatttaacatggaaaagaaaaatggtaggaaagtgttccaggcagagggagaattatgccaagacagcaggacagaagaaagcttgggtggccatggaattgcaaggaggccaataggggaggaacaggaccagaaagggaaggagtgggctggatgaagttggaggggcaagaaagggcaggtcatgtgggcctgataggtcatggaagttagcctggtttttacttggattctactctagatgaagtgggaaagtattggagggtttttggcagggggaggacatggtgtggcttgcattttcagaggatccctctggcaagtggatgaaagaggagctagacaggaagccaggcacacttggggggcactgcagtggtccaaagatcatggtggacttcactaagcaatggaaatggacagaagtggatggatttaagatatattttgagagtagaataggtaggacttcctgggtgattggctccaggtttgagaacagatggtgttgcagaaagtgaaagaagatcacagaaaactcccagatttcagacataagcaaatggtctgatggaaggaaatgaggtgaggaggggagacaccctctgcttgcgaggtatttatcttctttctgttttctctttctttctggattcacaactatcttactcatagcacggagtgaggatagaatatattatcaatagctacagctatttctatcgatgatgaagtttccagacctcagtgcacaagatactgatctacgtcatccactgactcattcaacaaacatgtgctgagtactgggccctgagctagacacagagataaatggaacataaccctggatctcaaagatcttccatccactggagctgataatgcattgtatcatttaaggatgctcttggctgcaagtaacaggaaacctcaactcaaaatagctgaacaatgaggacacctacagaaatgcaaatttacaggagtggtgagcttcaaggatggcccatctggtgactcagtaatggccaagaatccaggtgccatctggttgcttcactctgctttccataattttgacctcatcctaagacagcatgcactcacaattgcaggatggctcctagtagcagttttggctacatgcttttctattcatgcatgactggagagagtaagcttggcctctcataggtctcttggtgctaagaggaactttcccggaagcttctaacaaacttctctttatgtcctgctggacatagttggggcacagatcccttactaaaccagtgtggaatgggacccatcagcctgtacctctgcccctgaattcctttcctttatctgttcctccctacgtgagtgaatgggaccaccattctccagttgctcagccaaaaaccacgaagtcattcttaactcctgcccttgatccaatctcctcaactaatccaccctcactcatccctgactgttagggttgaattgtatctaacctcacacctccagatttatatactaaagtcctaactccccaaacctcagaatgggtccttatttgaaatgtggtcattgcagatataattaattaagaagaggtcatattggagtaaggcccactctactccaatatgactggtgtcctttatagaaagaggacacaaagacagacacgggtacagagtgaattttgttcccctccaaacttcatatgttgaagtcctaacccctagtacctcagaatgtgaccttatttggagacaatctttacaaagcaaataacattaaaatgaggtcactagagtgggccctaatccaacgtgactggtaccctgataaaaaggggaaatgtggagatagacaggcacaggaggaagatgatgtaaacaggcatggggagaagatggccatctgtgagccagagagagaaggctggaactgagccttccttcaaagccctcagaaggaatccactctgccaacaccttgatcttggacttctgacctctagaactatggaataacacatttcagttctttcagtcactcagtccgtggtactttgttacagcagctctagaaaagtaatatattgcctagcttccaaaaggcttctcaccacttccaccattccaccactcaaccggtccaaactgccatcccctcactggggctaccaggacactgattcctgagccttcatcagggtgctaccagcagccttcagaatggccactatgttctttcttagtggctggacatttacctgacattgaccatttagtcaatgtcaaggctttatgtcctctattggacatttatctgccttttaggctccccagcatcagaagccctcttcccgcctgggagactttcctgcctcagaatcctgagtggggaaacaaaggacacataactacagaagccaaacatgccagacacccgctctcccagcatcctctgcagctggaagtggacatgtgaccaaggctcagccaatcagatgctggaactttgatcaaggtgttactggggctaagacatggggctgaggaggattctccagcagcagagggagctctggtgggattgggtttgggggcagcagcaggggagctgcaatgtcctgtgccagcggtgcagtcaatggcagtggtggctgcagcggagcccataggaccagctctgggagtgatttagggtagtatctccagctacagagcttccaggcctggctctccagccctcccactgatcctgtgagcaacccactcttttcaacaacttttttggctttagttgttccttacaactatggaaatacagaaactctagcaaagcacataaataatctcacttcaccctcacgacaaccctagtggtaaaagccctcatttacaaacaaggggcctgagagttatataacctgcccacagtcacggcttatatgcactgggaggcttttgtggtggagctgccaaacttcagggcacaaatacaactgctccacaaactgaactcttgaacttatgattaagatgtgaaagttaagcagataaacctaatggtgcatttattgatttaagagtaaatattggctgggtgcagtggctcatgcctgtaattccaacactttgggaggccaaggcaggcagatcacctgaggttaggagtttgagactagcctggccaacatggtgaaaccccatctctactaaaaatagaaaaattagctgggtgtggtggtgcacgcctctagtcccagctactctggaggctgaggctggggaatatcttgaaccctggaggcagaggttgcagggagccaagattgcgccactgcactccagcctgggggactgagcgagactccatctaaaacaaaaaaaaagagtaaatatcaactatatcaactaagcctttgcttgggctggatactccgtcagaccgtggtgaatacagcagcaaccacccccaaggagcacagagtctagtgggagaaacagtgatgattgctaagcgcaaggattagaggggccacagcaagacagggggtagaggctgccccaggaactactgcaagtatgtacagagtaaagacccttcagagaagctggcataagtaatgagtatccaggacttcacagacacccctcctgccacctgataaacaggagacctccacatgtgcaaggtcactcttgcacgtgaacttgctccctatggcactcttatagtaattcaagcaattgcagctgtcttgcaaggagtcaggctaatacccaccctggaaggcctcagtaatgactggcttcctggaattaatgtaaggaaatgaaaaggatgctgattgggaggaaattttgtcttttcctttgtgttgcactgcattcaggagcctggtgggaaaagagagggttttcagctcacccactaccaagcattgctttgggagtctgtggaagtttcttactgtgacgttgggaaatggctgacagaagcctctatagactctggaggggccagaagacttgctgcatagcctaggccccctgcaggaacacttttctcaaaagttccccgaaagctgtttgccccaatgcttttggcaactgaacgtttgtcttccaggtctgaattcagcaatagcccaggtgaaaggccttgttaccacaaggctgaagccagtgatgaagtttgctcagagaattcactgcactaacattccccaagcttgagatttgtgaacctcacctatggcaaaacatgactggtcatgcatgatacagaatgggtgcttaaataagaattcgttttgagtttctgctgtgtggcagtaaccatataataataaaacaggtaacccacacatcatagttacaatatgctctgtactattctaagaactggaggcatactgactcacttcttaccctccacaagggtactatttgttacctctgttttgggcagatgtggtatctgagccacagagccacaaggggccctcccaagctcacaccattggcatgcgatgtcaccaggactcagccccagtgagcagggatccagagtccatctcttaaccattacttttttccaactctaagtgtagaaaatataaagatgatgatatcaatacctctgttttaggggagaagaggagacatggaatgaagattggttgactgctaagtatgtatcagacatttggatatctcatctcattcaacccttgtagccatcctgagaagtttcattcacaacagagaagtctggagtggagaaacacatcccacagccatgccaaagatggtagaactgcagggcctgctagacctcacagtgctctcctcttcctggacatactgccaggccaccttacccagttccttgcatctaggtggggccatatgactacttctcaagcaaggagtgtaagtacaagggacatgtgtgacctccaccaagacgctgagaatgtgtttgcctgctccacgcttgctcctgtcagctggccagccacagaggatctagcagaggactccaaagtcctagagaatggtggaaccacttcacttaaggaacctgggtccctgaatggcttcatggagcagagtgttcctgctcatctccttcaaatgaggtgatataaatgggaattttcactgtgttaagccactgagatacagggcttgtttattacagcagcaagtttgccctgctgacacaatcaacgtaactacagagcccatgccatcacaattgcactgtgacctgaggcttcaagaaggaggagagatttaggccaagtcatgaaggcttggagatataaacctttacctagagctttccttttatgtgttgggagaactcgatcctgtttgaagaaaacaatctgcaataaaaatttgctttaagatcactgtggtaggtaacctctaggcctgctttgggacatctcactcattcctatcttacttgggattccttgttttactttttcattcagccaacagccacgaggcacattcttgtatctttctatctgactttacaggtctgcttcctcactaccaggggcccagcttcccatcctttcttctagatacaaattctgctgtttcttgccttcaaggagttcaagatctagtggagacagtagtcaagtaaacatacaattataacatggaataaaaatgccatgacaataggaagccaagaaaggctgtggaatccaagtcaagcaagcaagaagggcagacggagtgggctcagttacaggacgacaggcagagttaacagaattcttgaaggtgcagaaaccggagaccacaggttgccacacaggaggtataaaagacgcagtgggttgaaaggtggcccagtagaaggttggaggctgcctgtacctggctttgcctgccagcctcaggagtctacacaaaattccatgggcactggggagccattggagggttttagcacggaattgatagctctaatttgtggttaagaatgttcttcataggtgcagtgtgaaggacatttcagggattagactagaggatgctaggcctgttaggaagctcctgcaattggtatgagatgatgagtctgatcaaaattgttatgagttgctccagaagcattgatgttacggctagtactaactacagcctaaactgcaaacaactgaataaaaggctacatggttaaagcaaaggaagcttaagaaagagccaagagttctggatttaacacttgcttgcatcactgagtctttctgtggccttgggtgatcttaagcaatctgtgtgcctctctggaagtgctgtcaatgttaaaggtagttggaattggcttttttccactctcagctctgccacttctttgctgggtgaccttgagtaagttacttaacctctctgcgcctcaggttcctcatctgttaaatcattgccctccttgaagagttactgtgaagatttaatgagagaatgaagatacagcacagtgctgggtcgatatgaagtacacaataaaaaccggaaattggggtggttggtggtagtgttgttgatatttttactgctatatttgtaaaataaggggcctaggctcatttatttgtcagattcaagaatccatgaatcacttaccattatctcccaggccaggaacctggggaccaagcctctggacataaaattgaactctgcaattcccagccaagactggcttagagcatctccaaataataaaagaaattgccagacaatgggaggcaaattacctcgtagcccgtttaacaatattaatgtgccttactgattcacacagagcctcccgtgaactcacttggaacgattctcaggagtcctgtaaaaatacacggaagtaacacttggtagctgggccagagtacacacaccattgcataagagaggaagtcatgccacaatgccttagggctttataaagacagtctgcaccactgaacacactggcacagggaagaacgcagtccagaagtccttaaaaaagtacccattgttgaaccaggccctctgaagttagggccccacaagaacaaaattccacaatcccagcagtgctacctaatgtcgcctggctccccgaggtaaggcctcctgtgtagaaaagagctctcacagcacgcctgagacttctcttcctagaaaagcctgctgcagggtaagtcccgggcttgcatctgggaacttggatgttggaagggttgccaccgttcccagatctggtaagagtgactcagtgtacctaaactgtgcaaacagtgtggtttatgctgtctcagtgtggtttatatctgctttctttctgggaatctggaattttctgcttgccaagcagagagtgcctatgtgaccaccccccgagaaaaaccctggactccaagtctctaatgagtttccttgttagacaaatttcacaagagttgtcacaactcgttgctgtggggatgaagcgcgtcccgtgaggctctgctagaagagttctttggagcttgcccctggtttcctctggacttcacccctgcacctttttcctttgctgacttagcattgtgttccaccactgtgatcagtcatagctgtgagtactaccgcattcctgtgccaacgcctgtgactcatgccagtgaattatcctacctgaaggtggtgttgggtgaccccagtacacctcccttgtcctaaggaaaaaactcagctcccattttggcttgacttgagcattaggtttgcaggtttgtggtgttttttcctcctccccaagtgattctcccagaggagcctggctgactcactgggaaagaggctcctgtgcctccagacacctgagactattttgttcccacagttagctttcagaatgaaatgaaacatgatgaaagaggaaacatcaattacaagcaacagccaggcaagtaaggctttcagagcctcctgggtttcccctcagccacctttgcagtgagggggcagccaaatgcttgggtttaattagttgaaacataaagaaggtaagtttcattgtctatttggccccaggcagaagcagagaagtgaatgcactcccaatattattcttattcaatcacagtcctgagccttcctcctgctggaacattcttttgagaggttgcatagctgtgtttacagggaacagtgcattttcgcagacttgagatgatattttgctctcctttttgcatatcctccggttggccggaatgaaaagggcaaattgttttcattaccagtcaattcacttctggatgcttgaggtagcaggggccccgtctgcaacatcaattctggaataactcatttatagaatgggaataagaacccctagcttgtagatgaggccgccagaaggatgaaatgaggtgtgtgaagtcccgagcatgatgtcagcatacagcaggtgctcaataaatttcagggtcttcccctatgggtcagaaatagggtgcttctagtttcacttgtctggtttgttcacaccagctgtgcaactccaacacagccctccaagtttccctacctcccatcttgctggatcagctatccccagctctctggctgcagcaaccactgcccccactgcactaagctgagcttcctggagatttgatgggaccgagttcctttccccatttggctcaacaaaggcatttttcttggagaaactttatgaaatgagaaaattctatatcaaagaggcaggctgtccagctctaatcgctgggacctccagggcatggtgcggggggagttggcactcacagcctgggacacctggacaccaacgccccaggctggaaaaggtccctgggccctcatcagtcagcagctgtgctggctctgatcaaatcaaaccaaaccaaacaatgactcacagatcccaatttaaacaatgcagcagcatctcatattagagaaaaattggaaacaacctcagaggcccacattaggaagataggacatcacaggaggcagctccacactgctgttaaacatcctggtgatgcagaacttccaatagcatagaaaggtgcttacaaataaatagtaagccaaaaaagagagtattaaacagtatatatgatgatcttcagaaaaaagagtggatttagatgacacattaaaagcggcctctggatggagtctgggttttgactgtgttcaggcccaagtgtaccatctattagctaggtagccttaggccagtcactcaatctctcccttatttgtaatacagggttatcagcataaatctgccatgtggggctggtatacaaatgagagagatcatctctcactcacagaagaatgtttgtatgtgtagcttcattatcaaatttctgtgcggtggtttttttttttttttttcctaatggaagtctgttgcttttatagttactgagataaagtgagacaaaagcaagagtaaaactgaaaagagcggggggtgaggggacaaaactctgggattcagagatacccatttcatagacataattgcccgttgtttctgcagtgacacaatgcacagggtcctcctgtaatctcagccctcttccaccaaagtcttgagccctgctatgcctccccctcaccccaaccagaacttatgtcgtttgacacagtctctgctcatcattccctcctggtttccttgagaatgggtctcaggccacaccagaggcacctgccaggcgacatgcttctttctctaagagcgcctgggttcccagagcagcctgctaagatggcattatggggtgggattaactgaaagcaccagaacttgcttttgggttctctctctgttggttcacttgaatcttgtttgatcaggttctaacatctgtggctaactgggcagctctacccttatagagggaaatgttgattttgctttttattatcatttgtttatctgcctttagggaaggagcagacaggagaaaataatagaatataccatttatgctgggaaatgcattgagtcaacttaattgctctacagaaaccctgggcttaaatactaacaccatgaaggacaagagtctgtgtctcccctcccaagaagacaaaacatggctaactcaaaaaccactggaaaagtgagtaatttcttatcaaagccaagccattcagtattatttctgtggctgccagtgttgtttcaaataagtcctaatttatattggatggtgtggggccaatgagttagactcctaaagttaagttctcattcattctttctcactccttccttctctcactcactaattcattttacaaacattttttgagtattttctgtttataatatgcatttgtgtaatgtaaatcttatatacacagtagacaactgtataataaagtttggctggcctttgtccctggttcttgggatgtagcctgtgaattcttgggatttcttgagttattcatggcagacctctcagaatcccttgatagtgtatgttaacaagataactcaggatgggggttggccatgcaagaaagaccagccatgtgatagagggttggggctttgagccaagtgacatcagccctacctccagggaagagaggaggaccaaagattgagttcaaccttatggccaatgatttgatcaatcacatctacatgatgaaaccccaataaaaatttggaacactgaagcttgggtgagcttccctggtagacaacactctgtgggaggagagagaacaccagagctggaatccttccagaccttgccctgtgatctcttcttgtggcttattctgattcgtatcctttttgctataataaagctgtaattctaagcatagcacttcctgagttctgtgagtcatttgagcaaattatcaaaccagaaggggtagtgagaacccccaaatgtgttaccatatgttcacggaacccctgagcctgtcgctggtgtctgaagtaaggccagtcttgtgaacggctgtgctcttaacctgtgaagtttggcctaaatggctagttagcatcaggagtcatggcgaagctgtgtgcgaggtactttgatagacgccagggaaacaaatgaacagtattgttttaggtgacactttgatctgtacaatcctgactgctatacttttgccaagcctccaagcatttcccccaagctacaggccagaaactgcacaaacaggcaccaagttcactgtctacccttttgattagccctgaactgtcccgcccacctcaccttctgttcccccaaccactgcattccctgtttgctttctaatttttattttcattcataactcctattcaacacattcattatctcaactttggtccttttttcttggcgacttttcttaatgtccatcccccagtggtcgttctgcctaggctgactgttctcttgggctcattgcaatgtgggatcctcctacaatcataggaagtgcgtgagtcccaggtcaggaatccatccaggtccatcacctcaatagttgcttctcatggatcagctactcttgaacccctcaccctttggcttgttttttgtcttggttgggcccttttggactgaagtctgggctccatactgtcggccctgccacagaccttgcatttctttagaacattgcttccagaatcttcctgtaggctctgtggacaacacccatgagcaagaggagctttgactcatgctttgcccaggcaccaccatcccacccaggcctgtatcagccctgtctgcccatttcagtccccagagaatgtcccttggggctcagaaccccccactccagtctgtgggtctccatccagcccttaacaacctctcaggtggattctagacactgggtgctcacaggtaccaagaggacatctttcagcacaactctggcaatcatcccagatgattctagcagtataatgaagcaggttccaggcactgcaacattttcctactaaaggtcaacgattacaatggcataaatctgaagccattttcaaggattcagattagcacatttgcatgcatgactgtctgaaaattcaggctacatttgattggtatgcaaattagccctaaatttggcagtcttttacaataacttcaggatgttttagacagacaggtaagtaagtagatggatagacagaaagatacaactatgccaattggagctagtcactggaaacagaaaggacaaagcctagacaatcagcaatacatgaacaaaagaaaggagattagaaagcaaacatcttcaggaagatttaggtgctcctatttagatgctatgcagcataggctgtggattaattattcagccagccagccctctgcccagaggtactaatgacacaaggaatctacaagagcctcctcccttttctaaaacctctagcacaggggttagccaacaattggccagcaagggaaaccctagaccaccatctgtttcgtaaataaaatgttattggcacataccctcacccattcatttacatatcatctataactgctttatctctacatagcagagttcagtagttgcaacagagaccatatggccaacaaagaaaaaccacgcactatctggacctccacagaacatttgctggaccttcacagaacgtttgctgattcacagaatgcagcagatcagcctagtggaacagaaagaagggatactcaggaattagacagaccagtgtccaagtccccatctgtgaacatggtggaggtggtcccagaagttttccataggacagactcacagctggcaatttgtttgagagtgaagagacctaaggacttgccttggactcactttaaatttaaatttatccatttgctcatttagcaaatattttttataaatgcttacaatgtgtcagacattgttctaggtgctggcactgcagaagcaaggacctttctaaagtgaagggaaggaggacaagaagtaaaggaatatgtcatatctcaggtagtgttaaataccatgaggagaaataaattcggtgagggctaaagcgtgatggaggggtgccattttggataggctggtcagggaagacatttctgaggaggggacgtctgagcagaggcaagaagtaatcaaaggagagtgcacaggaaaatcaagggaagagcactgcagccagcaggagcagcacgcacaaaggctctgaggttccagcgtgcggtgtgtttgaggggcagcaagtggggagaagtttgtgtaaatggagaagagggagtgaggggggaaatgatgatgacagagtggtcacatctgtcatgtgtcatgtgtcacggccccaggtaccgtgtaagtcaccacagtctggcttgctttctagatatagtgggttttgagcggagggacaatatgatcttgcttcatttgtcaaggatccctttggcctttgggtggagactaaactgtaggaaccagagtggaaacagagaaaccagttagggtttagtgtagagaatgaatagagcctagctactgtggtgttcatcttggtgatcaacgcaccagcacagcacagataaccctgattttcaacagctaaggacaataagaacctcttgccagttcatgcaaagtccagtgtgcgtttaatagttctctgccatctgggggaagaaaggactgaagatctttcttcagtgctgccataaccagggatgctgccataaaccaggcctcatgtggcctatcagcacctctgttcacatcccatccaccaagctggccaaggacccttgtggatgcacgaggtgcaggtgttctcttccaaatgaggcatgaaaagtagtcagatcctggggattcttggaaagttgggtggccaggaggcacatccaggtgactgtgttgaggagaagccagtgggaatgtttaggaagtgtcccacccctgaaacttggatgtattgggttccctcagcctcagtttcctcgcctttaaaagggggttagtgatagctgccttgcaatattataacaaggatccagtgtgcacacaattctgaacctgggtcaagtgcagagctggtgcccagaggcgagttattttcattttcggcattacagaaagtttccaaatatctgaggagagaggagcactgagcgtttttaaggttgaggctgggtggcagcagggccaacggcagctactgcatggattgttctaacagtgcaagctgcctgccctgaaggtaaatgcccactgcctggagtctgtgccccgatcacctgggcccccagttatctaacagctggaaaggcgaagctggctgggccgaggacttacaagcctgggccagtgctaaaggcagcacaccttcccatggggcagcatccacacaccaccccctggtggcagcctttgttcatcatctctgtgagcagataccctccccgcactccaaagcagcactaatatctgcacctcttctgttccaagggtttctttctccttctcgagagcccagcaccccaggtgaagcctagctctcacaccctaaacccctgccaggcttgggtccttccagcctgtgttagattccattccttagaggctctgctctgttcctggtctccctggttctggggctgcctcactcacccgtttctaagcccactgcaaggagaagagagaattcgaggtgatcgctggacgctgggctgagctcctccagcatcacatctcctttcatttcgcagcgacctcacaaggggctcgacaccagccctttacagaggcacctacatggtgcctgggattctctgcaggattctgagctgggattctgtgcaggcctgctcagctcacactcagggcagtttccacctcggaagggcctcccagggcgagccttggccctcagcctgctcatagcctgggtggtgctggatcatgctcctgttctggcctctgcaacctttctgatctggcttcagctcccctttccagcctctacctctccaccccactggaccccacatccagctacccttaggtctccaccattcccagaaagccttgagctctctctttcaagccccagtgaggccccactgacctccccaggtagaatacagtccttcagctgtcctgtggctccatgcagcctgtctcactggtgattatttattgagcctctgtcactgctgctggtcttggggcacctcgaggacatggatgtgtgtcgttttcatctttctaccccagatacagcaaggtcaacacccagggaagggcactgaaggattgcctgaacagctacccctctcttctcacaaagcagcacaagtaaacataaaacatcaggacctttaggcagagcaggaagaggttacatgaccccaaaccccatagggaggggaagagtttggggaatgattctagctaataataaagctgtcttcggtttctcagttagatcaggtcctttatgagaattgctctatgagaaccccgagggagggaggggttgggacaggattcagacaatcacaggtgcctgcttgtaacacgatggcagcatcatccaccttatgcttgagcccctagggttgttgcagtgaaaccttgctctgtcttttggttggtagatggacaggtaagtagccctgggcttgctgtggctcctcccatctccccttgttcctctttgcctttattgatcatgccaaactccccccatggctggactgttggcgcctgccattagtggtcaggggcaggaaggaggggcagagagcatggcacggatcttggattcagacagacctgggtttgaattccaacactgccacctcctggctgtgtgaacctgggcaagttgcttaaactgagcttctgtttctttgttcatgaaatgaaggtaacatcagtaattaactaccttgacctgaattgtgtcccctccaaaaatgttgcatgacatttttgttgcaaggatagggcatgttgaagccctaaccccgatgtgatggtatttggagatgaggcctttgggaggttactggggttagcagaggtcatgggggcggcctcatggtgggatgagtatcttgctcccttgcactcttcctccctctgccatgtacaggcagtgagaaagaggccgtctgcaagccagaaggaaggtccttgccagacaacgaatccaccggcactttgattttggatttccaggttggagaagtatgggaaaataaatgtcttgctgaagaccccaggctgtgctgttttgttacagccaaagacactgacgtctctgtatttctgagaatggaatgcgcctggcatgcagtacattttggcagagttgatgagctggccatcacagtctctgctcctcttcaaaggcagagagcacatgctgggaagtagctacccaactggggatgacacttcccaggccgtggatctgggcagatggctcagtcctggactcaaggcctcctcggggtgcttgctctgggctcctctaaagtatgcatgacgagccgtggtctcgaggttcaaaggacaccaggctaaaaagcgccttgtgatgtctcaagactgaacaccttgctgcgcatactggccacagaggtagagctccgatatcccaaacaagaagtcccatggcctaacactgcctggcacagaaaggatctgttttaaaaatgactgaaaatgtgtctgatgcctgggaaaccagaagcccgcccagggccaaactctggctccactcattatgtgactgtgggaaagtcagtgaacagtgtgcctcagtttcgtcatctgtaaaatggggataatgatgatccatacctcacagggctgtcatgagggtgcactgagctgattaacgcatgaaaagtacatggaggagggccggcacctcatgagggctttttccatctgtgctcttactgatgctgccataatatgtgtcactcatcttaagaacggtaaaggccaccctggctgtgtagatcttcagaaatctcctttcccgaaacggagggagggcacgttaaactctctctgtttggcttaccatggtctttcccattaaatacctctaagctctggcccctcctgtccttctcactgacaccaaagttgtttttctaaaaaacagtgagcatattaaataagtaaataaataaggaggcacgtgttctcaggacctcctgagggtgtgtcatggttaaagaaaaataaattttaattaaaaaaatgtgagttgcaaacccccacccccatgaatctgccatggctccctactgcccaagactaaaatcctactcctcagcctaagatcttaggccctcttcttttgactccatcctgcttttccacctcttctttcatcccagctctgcattccccctaggtactggcacatcacacgctactaacttcctaatatgccaccatgtgggcacagccaggcctctgtgtgtgtgcttcagctccccacctccctttgacacctgtggaaattctacacatccctcatgactcagctcaaataccacctcctccaggctgtcttccctgatccccagagttggatacattataaactctcaacaatgcttgctgaatgaataagtgagtaatgggattcctccgtcctcatgttcccatagtcagtgcttgaacccatatcattctatcccaggtgtaagtttcacataactctgctccacaagccatgagtgcaaaggttctcccccacctctcacctggatgttttgatgaactttcaagatgaagcaagagtccaaattcctagccctctttcaaagacaaatatcgacaagccagatccccatcttggaatgacgtcacaatgacaaaatcaaagatcactgactgttggcagtgcttactgaagccatctaggccccctggttttcaaacagtttttagcaacagaaatgaacaatgtcaaataattaacagactttttaaacatagaactgacctgcgcaaatagtgcttagatccgtgaggcacctctgcaaaattccagggctcatgggaacctttgaaactcactgacccaggcttcccctatgttttgtacacaaggatgctggactcccaagcaaggaaaagcctggaaggcacccagggctgtcctcagcctgcttcctgtctgcccccaaaacagcttgtgctccaagaacctggagctccccgcatttccccagatgtgtcctacatccgtgtccccaaaacggcctgtgctccaagaacctggagctccccgcatttccccagatgtgtcctatatccgtgtctccaaaacggcctgtgctccaagaacctggagctccccgcatttccccagatgtgtcctacatcccggccccccatccatcactccaccttccaaacttagtcaggcatcacttcctgcaggaaagcttccctcaagcctccaacctgcccttgcctgtgggtggtggtaggtcaaagccaaagccagcacccacaggatagcatctaaaccttacagcctaggtaggcagtacccaacctttaactgcaaaccagaggcacaatgtgaagagggcctgggagaattgcacctggatctgatttcagagtaaaacacaagccaaagatgggtcttatccagcagatacctgagtggcctctggttgtaatttaaagtcaacaacaccaggccgggcacagtggctcaagcctataatcccagcactttgggaggccaaggtgggcggatcgcttgaggctgggagttccagaccagcctagccaatatggcggaacaccacctctacaaatacaaaaattagtcgggtgtggtggtgcatgcctgtagccccagttactcgggaggctgaggcagaagaatcacttgaacgtgggaggcggcggttgcagtgagccgagatcgcaccactgcactccagcctggtgacagagtgagactccatctcaaagatgatagatagatagatagatagatagatagatagatagatagataacaacaacaacaaaacaaatcaagaaaatgtccaagtttccatgcataaggcccctcctggttctttccccggcattaggggccagaggatcgccccccaccccaccccgggacttccgaagccccctctcatctagtctcccaacgttctcccaggacacccgccctccagccgcaagaactgtcatcccccgcccctgtccccgtgtcatcattgtctgtctctgtgcctcccctctcccccgagtgggggctaatctctgtccccgcggtgtcccgcgccgcgagcgcaacaggagggggcgctggagcccagggcccttgcgcacccgaaggtttccgcagggccgcagcgccctctgccgggccttggcgcgcactcaccggggtgggggcattcaccaccgacaggttgtagccgtagaggaaggaggagccgaaggcgcccgcgagggaggccacgaggagcgagcaggaccagtcctgaggggagaggaaaccacgtcagagccggcaccgggcgcgcagccagggccgagggaagacctggaacgttccctcagctgggggaggccttccggaggagaagtctttgtccttggctggggtagagacagagagaagagacgcaagttggggacctgcaagtagggttccagtccaggtccgcgtgcgcaggccgggcgccctcaggtttagcggccacgcccttgcgttccttccgggttgcgtgaggattcctgaaacgcagttttcagcagctgctctgggcagctccacacgatcctttcagcgaagttggcgagtgtccgacccagacagaaaaaagcaaagccagactccaagcgctatcagccaggcgtgattctaagcacttttctgcgcattgtctctgagtccttagatcagtgctgttatgtcctgtattacaggtgaggaaagaggggcagggagcgtggctggtgctgtctaggatggggactgaagtccaggtggcctggctgcagtgcccctctagtcaccactgcactgtcccctgctgacccgtcacctgagtgccgttgtccaagggcctgagactgccgacagccagacagatgtgcacacacgcttacatgcacatactgttccagtctgaggcgtcaaactacaggggctggtccaagcctcaggacaaggacctgcagacgtagagatgcaaggtttggcacagagaacagggcgcctgccttggtgttgtcctgccctgcagccccatctaaggacagccaccaccagtacagggccatagggcagaaacacctggatccctggcaaaggctgacaagctggcatgagccagggcaggagggatggctgtcctcagctggtcagggaatacaggccaagtggacaggggccaggtgctccggaaggcaccttctttgccatcatttgacatatttgtgagtgtgtgtgtgtgtgtgtgtgtgtgtgtgtgtgttgtaggcgccaggccctgacaaagctgtgggggtgcaacagtgaagaagacatatggatccatggttcagggacccatatcagtcaaatcccgtctggaagggaatgcgggtctcttgatggccacttacctgctctgccagtctcgtttgtctcctctagtgccaccagccacgagatagagctttggggctttgagccaagtgatatcagctttacctccagggccagtcccctcagctgtaggagtctgagcaagtgacttgacttttctggggctcagcttgcccacctgtgaaatgggatcttaatagcagcactggccacatatgttgttgaggagcctgctgcagaggaggtgctccgtagaggctgctgatcacatgcgggggcaagagggaacatttataagccttggggatgggtgctgccaattgaaatgtagtaccagaatatttttctgcagtgagaggagcttgagctgaatggggatccctgatggaacagaatcacatttcagatgaaacgcctgttctctatcactctttctctttaaacctatcctctgagtctcggcacagataccacttcttctgagcccctgggctgtgctgggcatcgtttctgtgctctgtgccttctttgctcccagccccgatgaccttagaggacacaaactcctccctggtctgcaccccatcagattgggagcacctggtgtgaagtgcccctgccagaggctggtgaagggcaggtgggggccatcttctcctgcctcagctgtgctccccggagccccctgcctgtgtggcccgcctgtgccctccacccgctccccactcactgcacgggcagagggtgcccactgaccgacggtgctgctgcccgtgccatgccctggggagggtgagaagagggacaccaccatgcaagtgcggggcagggcagcctgccaccatagcctcattccatgtacacacccagtctaccagagacgctgttggcccagtcagctggggcttggagagagcatgccaaagtcacacagatggagaagtgcaactcaaactgaggcctccctgcctcaaagccccagatcccccagctacacgctgccaggctggggctgagcactgtcacacggctgccacccaggcctgccttccccacagcccgccagccatgcagaaaagctgtccgtagttacctttcttctccttccacctggcaccccactcctcaggtggtcacactccagcagtgccctccctggccctggaggcccggcgtggctggtgtcatctgtgaggggaactaggcccagttccttggaattcctattttgtttccttgccatgggtctcagtgacccagctgatggctcagtccagggaccccagactctgccaaggcatttc

SEQ ID NO: 1360 - DNA, 48255 bp, Homo sapiens
gacattgaccagaaaaagtgtttattcatcaagtctttaaagatacaaaaacacgtgtcttctgtggagctctgagaacaggactccagcaaagcacttttcagccttgtggtcttcaagcatttccaagatctgtgacattggaaagaaaaaaaattaagacagatttgggtctccatgagcagagagtattctttcccttagttctgggtagcatagtgcccaaggaaacctaatcagtacagtgggaaaccaaatctattccaaatcattacccataagcaatcctatggactctctgaggtttgacagagtcagcggccctctccaataaatgtgtttttctataataatgtgcagtgtgagtaatttgatgtttttgacaaatatttacccagcgttttatgaaggagaaggtttggggggcaagctgaaggagctctgactgccttttggaggagtgtgagtggcttacctttgctgcaaggagcattgtactcagcaattgcaaactcatctgaaaaaaaaaaaaccaacaaaaaaccagaaatcattacatgaagtgagaaagaaagcaaacatctgtgggatacaggccaaggaaggagtttgttgtgggaagaacagtattgtaccagaaacataagcatcattcatctgatgtgttgcttgctaccttatattctcctttcaaatatagtgttttatatattcttttatcccaaactcctgaaggactcttcagatgttctacttacttaaatctcatattgtcatacagtccatttatctgatgaaaagggaactaaatatcccacaggtgttttgtattagtagttgataaatttataatgtaggttgtttctataatgtatgtataagagacaaaaagaggggcatcagacttgatggagacaaaatgaagtgataatgtaattacttaatgtaataaataaccccaacacatctcctaaacctgaatttctgtgatcaggaattaaatatttctacgtgaaaatcactctcactcacccgtctcgtagtaatcatagactttcactatggctggtttcagatctcttactgggacatcttgcagaaccgtgaagaacaagctcagtgtctgatttgacacctggaaagcaaaagtcaattaaatgacctttcaggaagctttcttctctctttgaattagtttaagtattcacctgttttttgggggaaaagctttattatcctacagcacactatagggtccttaattaaattgtgcagaaatctctcagaggggatgataaattctccagattatttcttaaataactaacataacgcatatacctctgtcaatgccaatacatagctctgttcatgggggtaaatgatatatactttttattggatgactaactgtgttcattttttaatatccagagatttggtatagtttgacttctctgtcttgcaggaatacttgcgtagactcaaagaggcatctaaaaggttgatcttcccaggcttaagtttcataaaatttgtaaactataattcccatcaacttatgcatgaacaaactctcctaccacacatatctataaaatcagattggtttactggtgaactggtcttattattttatggttcaagtccttgtggagactgacagttttttttccctttcatattgttgttgagtatgttgataattaactaataattgactaatcacaagggctacttccttatattactgggtatccaaaaaacttgtcaacataataaacacattttgtgaagatttcttgcttatgggattttaggaatattcatatcccaagatcataataagccatttctacctgtaatccctggtgaaatataaataaaggagagaagaacattcttttagagttaacattagaattctcaaatttctagcatggaagtgatgtttctaaaatgcatttaccttcccagatgttcccttagaggattattatctacgtttttttgcaaatagactggaagttctcttaccttatcaaggtaaatcaagacatggttgctgctgacttctgtccggctcacatggttagatctttcaagctgaagaaaattgaaataccacaaatgttaataaatagatgaaacccctgggggatccagagaaaaaatctttgtattgccaaaataaccctgagggtagaattcttcaaatgctttttgtaaggaaatatataatgtaatacaattaaaaatgaaaggcataaagggtttactattagtataacacacgactaatgtgtaaagttatttatctgaagaaaagacagctaagtatcctaaacttggtagttactcatatttcaaagttcaattcagtttctatttcttcataaggagtttttttcctgttttgcttgctctatttttcttttaacttctgtaatacttatagtttatgccaatcagtcattttcatatttttcactggttcgtgttcatatcttttatcttcttagcaaaattctaagctaagaagaaattgaaaagcaggaacctgctgacaatctttttcttgtagtcatgggtcctagcacagtgctctgcacatggtcagcattcatacaaacacatgtgattatatttctgagctggaaaaaggataaggctttgatagagattgactttaatagtattttgatattagtattgtcttatgctggggatacatacatcattaaataaaatagggcagtctggggttatgataaacctaccattttcactgttggcttcaggggaatgaagccagagaccatcttcacatcaacgatcgccatgttggaggcagagcggctccctgtgtaactgaggatccaggggaggaaaggattagggttttctgtgtttttaaatattttcttcttctatgtccatgttaagcattccacagctctaaaaggtacacgtaagtcttcccaaatatcttatcccagtggtttgtaaaagtggtgtgcgtagaatttttaggaagcctgttaaagccacagagaccaggccctactctagacctgatgaatcagaatgtctagtgtatgggggctgaggatctgcattttttttttttgatggagtttttcactcttcttgcccaggctggagtgcaatggcatgatttcggctcaccgcaacctccgcctcctgggttcaagtgattctcctgcctcagcctcccgagtagctgggattacaggcatgcaccaccacgtccgactaattttgtatttttagtacagacggggtttctccatgttggtcaggctggtcttgaactcccgacctaaggtaatctgcccgccttggcctcccaaagtgctgagattacaggcgtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtccccgagagtttgcatccgaaatttggactgcttaatttattttttggcatatatatacaccaaattaaatgaaaaaaatatatatatatatacttaacttttaggttcaggcgtacacatgcaggtttgttatataggtaaactcgtgtcatgggggtttggtgtacagattactttatcacttgggtactaaattttgcactgaattgttgtttttttctgatcttctccctcctcccatccttaaccctcaagtaggctctggtgtctgttgttctcctttttgtgtccatatgttctcatcatttagctcccacttacaaatgagaacatgcagtgtttggttttccattcctgtgctagtttgccaaggataatgacctccatctccatccatgttcctgcaaaggtcatgatctcattctttttgatgtgtgccagttatttgttacatgtattttgtcctaacttttttcctgaatagtatctccaaccaagtaataatatgtttgtggagagagagttttttatcagatctgcagctatttaaatattgatgcatataagtgtatcttccccccaaattaattatatcatatataacctgagatttattattgccagtaggaattctaactaaggagtcactacttccttctattcaaacttttcaataattcttcatctctatcttcaataaagcaagaataatataggatttcattacataacaaggaattcaggtcagaggcaatgggtaatatttacttagttgttattgagggaaattattaccctttaaacaatgaggttgcacaatagtagatcctggatggacaatgtaaaccccatcattgagaaattatatcaacttaagagaatacattgcattttttgtgaatagtgcaaatatctactgttgcactgctttacttaaagaggagttcccgaaagaagactggtggttattcttaggattaggtgatagagtcagaaggtcttacctgacacttagggagatttggaagctggtgtgggctttgggttcatcacaagtttgaggcagagtctgcactcctaaagcaaaggggaactcttccttttctgggagaatattgtatttcaaggatgtctatagaacatcaaagacaaaatcagttttttgccctttcccagaattcctgtccacgtccctaaccctttctctgatctgtcccattgttttctgagttaggacttctcagagagaacagctgctgtcctcatctgtcctgtcctcacctgcccaagagtctcacctggaggtagacacatccttctcctgtcactttcatgctgtattccccaggcagctctggcaatgagacctgctgcagtaacaggcggttgttgttgtccacttggaatttgctggaaaatgtccctgaagactggatagtcacctgtgcagccttcccagtcctggtaaatgtggctgctccatatttggacagagcatggagagccaccactgtgtcctgttagagacagatgagtgagagaacccattgggcattataaggctttgagggctgagatatttttcaaagacccatgtgagggactttgatttcctacttccctcactacttaaatataggagctgtaatttcaagattgattataatctttagatagttgaagaaccataacattcacatatctaccttggactgtatgccctacatgtttattttatttatcagaaaattgatccttttctctctgtaagtatatgtgggacatggaatgtggaaaacatgtgaatggcaatcagttattggcatcagctatttgctaacatgtctttcttgacaactatgctcatatctgccaccactcaagcaaagttcagtctggctctctcccatattaaactttgctcagttgctgaggtcagtgtcctggagagaacccaaggttctttgcagccatgagcagagtcatgcttcagtttctccaaaagaaataaaagatgagtattataattatcttctggatttaatgacatttttatttggctttccctttttattggatgatttcctgttcccagtgaatgtctgctggtatgtatcctcaacaacattaaacctgcttggcctccttcaaataatatgtttctaataaatgaatgataacctttaacaaaattacttagtttttttcattcatatgataaaagattaatacaatggaaataggatggaatgccattttgtcacattttttccgttttagggtatataagcaaacatccgaattctctgaagataaaactttctgctgtgtacatatcaatgaattgttcagatacatggttatatagctagatttaggaggttggatgaataaagacagttctttatgctcctgatgaataaatgtttgtgtattaagaggtgaatagggggctggacgcagtggctcacacctataatcctagcactttgtgaggccaaggcggatggattgcctgagctcaggacttcgagatcagcctgggcaacatggcaaaacctcgtctctactaaaaatacaaaaattagccaggcatgattgcacatgactgtaatcctagatacttgggaggctgaggcactagaatcgcttgaacctgggagatggaggttgcagtgagccgagattgcaccactgcattccagcctaggtgacagagcaagactctgtcttaaaaaaaaaaaaaaaaaaaaggtgaataggggaagcacaaaatgtgtagttttgagaaaagcctattaaaggggacctaagaatggagagatttgcgaggagaggttgttggattttgagtagagttcctttgaacagtttgaaagagaccctagagctttcaggagaatggcaggagacatctccttcattctgctggtgctccactgctgcttgaggaaggcagtgttgttatgggaaataggagatggataataacacagcgatggggtgccgggattctgagcatttccttttggccctctttgactttgatttgcttttatttccattatccttggatactgaaaacttttcctcatttcaagttactgtcatctgtatttttttcttcttggatgtgtttgtttctttttcattcaaatcttttgctacctgaaggtgaaataaaaggttttggcaaatcaccaacctgggtggaggagaaaccgccctgggcattctgctgcttcgtgatccacttcacgatgttggttgcagaggtcaggtcctccgaggttggggctggctgggccgtgagataagcgaggagcacataggatgtcatctccacctcagcagagggagcctggggttcgtaaaaatgccccactggtgccttgggtttctgagggcgctcccaatggacagagttgtcttaaagatgagaaaaagatatttataagtgcctacatatttatatttaattcaaggtgaaagtacccaagccagtgctgaaatgagaattgcatgcccattataatcccctgtactgtatgtagatgcttttcccttcatgtaaatctgaatttggtgtgttttagcccagctaaggcagatattgatgctggagtcagaagcctatgcctatctatgttttcaaatcgttgctatagtcgggttggtgggagaaagaaatggcacagcagttgtctcattgagtctggctatttcctatttatgatgttatattagactatagctggagtttgttacatttcctataaagtgtgtctttatcagtttcttgtgaggatcacagatcacatgaaatagtagagtttctactcattaaattgaaaaaaaaaatacagtaatccttgaaataccaaaggctgacatggatgtgaaacaatgggaaccaatatacactgctgtgggaagccaactgctctttggcaatattcagcaatggggaagatgtgcttagcccactaatcagtcattatgcttctcaaagcataatttggagaaacacagatgcacaagaaaacaggcacatgagtattcattgcagcattttttttaatagcaaaacataaaaaaaatccatgaggagaaactcgatgtgtaaattatgactaatttatagactgtaatatattatgcagcagtgaaaattaatgagctgactctgcacatacttgtataggggtcttcatcaacatagtgttgaacttagaaaataaaaagcagacaaacaaaaaactaagctgctgaaatattcaaaaatgtttctcttgtttcttgaataagagagaaataaaaatcttgtttctctcaagatgaaacacatgtgaagattctaaatattagttagggatacatatgcagcaaaaatataaggaaatccatggaattgtaacgacaaattcaggataatgattgcctctggaggtggtagtgatacacaagggatttatttttcccatgtcggtaattttctatttcttaatctatgagagagttgtacagtgttttctagttatagcttatgcccttttgtatatctattataaaatatttctcaatacattttaagaagaattaatggctgtcaaaggaaaaaggtagactgttttaatggacatcttgtgatttgcattttattttctatttcttcaaccgctcatatagaccatggtatatgtagaagtactgtgtgaatatgagtagattggtcaacattattggtcttatgaaatgggcttaaaataccagaattcattcaaggagttacttccatgattattttcttatgtttaaggttatataatgtaccaggtaagggttgggcatatattgagaactgatatgttaattgtaataactagtacttttataggatttgctatgtgacatgtactctactaagtgttttacgtgtaccaattcatttattacaacagctctgtgaggtaaatactattattatccccattttactgatgaaggaactgaaacacaaggaagttaatgactttcccaagctcacataggtagcacattttggagctagtctccagagaatgctcttcttaccagcatactatagagatggtccctgacttacaatggtcccacttaagattttttagactttacaatgagtttgtcaggatataaccccatcgtaattgagaagcatctgcacggcctcttgtcttctgatttctgatttgattaagaaatcctagattttataagatgcaatatggacaaaatatatatgatatatagaaaagaagagaggagacagggatcacaggaggtaggagtgagggatttttgccatgcagttcttgatacagaggatgggccaggagaaggatctcaggtgtgctctcacctttcttcacagcttcctcattaagtgacttgagtacttccttcctcttgtcctggttacctgccagggcaaaagcataggccagcagtgctttggtatatacatggctgccatggtccccttcttgtgctgtcttccaggctgactccaggcaaaacagggcattgcggacaacagggtgctgtgaaggcagaacaagaagggaactaagctatgtaaacaggcatattagcattcccaggcaaatacacggatcacagcacagaagtttttcaaacgcatttttccaacgattcctcattcttatcaatagatataatattatttttatctgttattctcacattcaaaagatacatctttaagattcttttttgagtggtggtggtaaatagcctaggggaattactgggaaaatttaaacctttcttaatgggctgaccaaattctctgtagatctgggaagcactggcattgcatagaaagaaagctgatgctttgcttttaataggatagtatttcagacagcaggtcagcagtttcattgcatccagaactctccttcagcagaggaatggggtggtacctacagtgactgtgagaggaatctccagaagggcgatggtgatataggcggagagggtcacttcatcttctactcctccctgtgaatacgagagagagatctgaataattcaacttctgagaatgctattgattagttctttctattctgctgtgtcatggaattcatccttacccatatccatccctatagggcaaagtatcacaatcaacttttgttctatcccctcttttttggtgccatccaggttttattttcctctgaggctttcccttagaatttttcacattatcacttcctatcctcatccttgcagatatcataatggacaaatcaaaactagctccagaatgattcacctttatggcattgttgagcagtgacccagagctcctgaaacagccattgtccttctgcctctgggagagccatatgagggcttgggtaatgtgtgcttcatcgatgaagatgtaggctcgagcttgggcaaaagtcttcagaacaaaggctgtgagcctgaccagggaggaagcaatcatgatgtttatgttgtcaaaatggttttataaccacttcacagcaacaggcttcatatgatgtgagttagctaacaaaattcttgtgtacttagagagcttatctccttgattaatctttagtctgcctgattaatctgctagatgtagtatttccttgctaactctctctttgccacagggagtcttagtatatttaattttattttagttccgagatacatgtgcagaacgtgcaggtttgttacataagtatacgtgtgccatggtggtttcttgcacctattgacccatccgcttagttccctcccgtcaccccacacctcccaacaggccctggtgtgtgttgttcctgtccctgtgtccgtgtgttctcattgcttaactcccacttatgagtgagaaatgtggtgtttggttttctgttcctgtgttagtttgctgaggctgatggcttccagcttcatccatgtccctgcaaaggacatgatttcatttctttttattgctgcatagtattccatgatgtatatgtaccacattttctttatccagtctgtcattgatgagcatttgggttagttccatgactttgttattgtaaatagtgccgcgataaacatacatgtgcatgtgtcattatagtagaatgatttatattcctttgggtatatacccagtaatgggattactaggtcaaatggtatttctggttctagatccttgaagaatcgccatactgtcttccacaatggttgaacaaatttacattcaagtaatttgaatgtacttatttttgttagttacttgagtaaggctttaaatctctcttatctttagagatttccttctgcagatgacagaatcttctcacatgcagctcttacatgcagtaaattttaatattgctttactttagggatttaaaaaaatgttttatattactgtttccttctcaattgtttcctcttattaatgaattcattccaagtcaagctgaatgacttagaatgtgacaatataagctgaagttaacatggtttatctggaagttatatatgttcactggcaatatcattttaaaactcatggttatggtagctactttagaaagaatagccatttcagaaagaaaaccttggtacattattaataggatccattttggaaacaagcctaacataacatgtatttggatatcaggttttcttctgattaccttgctaatcttggtggatttatctagtataacaaaccatcggtctgataatacatatctgatagtgttgctgtgaatataattgaggtaatacatgtaaaagagctggcacacaaaaagaagctcaaaaaattgttctttccttaccaggtgttgccctggttcctgccatatcgctccccaaaggtgctgtaggagccatcatagtgtttgtagttcaactgtctctggtaacctggaaaggaagattaacgaaacagcacaatggattaatgtgcatgctgagggtggagaaattactaaaagtaccttggcttctcttgtgacatttcttaaattttgttgtcatagattaggagtttctgagccttaaatattttattggaggttggagagtggatagtttccttgaaattaactatcatagcagctatcatagtgagctaagctaatgtatcataatattcataagtaactgaaacctactgggaaatccagttgaaataacattcaagttttcccttactcaagtaatcactcaccagtgttgagatagccaatggccttggacttgatctctggagtaagctgctgtgtttcatttagataatccagtacatagatgttaggagcaaagaggaccatattctgctctccacagccatagggcatctggagaagattttgtgtgttttgcatggcagagcctaatatgtctcctagagaatgggagagatgggaagtcataaagcttggagattatcatctatcaaagtcattaagcagaaataattagttgagcttagaaattgagaatttttaggaaggatgattcttccagggatagaagtatgattgaaagcaataaacaagcccaaagaagaagagaagaaagaagttaaaattatagtattatttttagtaaatatttatgggaaataaaaatagtataatagaagctgttaatgcccggatccactaggggctggagactcacccaaaactgagacagaagctcgggcagattcttctaccacatttggtggcagtttcagggataattcttcagaaacctcaccacctagagaaataagcaaatcagacatatgaaaattatttctgcattatatctttctaaacagctctatgacccagaagctaggactatgccttatacctaaactcctcctgaaaagttgtccgcctttaatacaacagtaatatataaatatcttaaaaatgggctactggtttcctgtgattttcagaatttcttcttcaatgatcttttcagtaatttatgtagaatcgcatgccaaataagacaacaaattgtaagagcctggtgatgttgtgattcagttgctgtcatctgatggctgacacaagacggttatcacaagatgatctatttagttcccaccaccaacttccttactcaacagttgtatggagaaaacaccaacaacaaagccctataagtatacataagtaaaattacccacaaaaggtcctgaattctataataatgctatgttctttcttcaaatttcatatacaaagatagtatttttatggaaaacctagaaaattgagggtaaggaagtgaagacgaacagtatttgatgcattgaaaataaaataattactactcatgaacatacatttacttccattttaatcttggtaaattatatgaaatgaaaatgagagaagtatggtatttattttcatactgaatcccttcctcataaaattcatattaaaatgtttcttaaaaaaaagccataagcatagttaaaggacaaatggctaagcaaaataaaatgcttgactcactgaaaataaaataactgctactgatgaacatacatttactacaattttagtattggtgaattatatacaaatgaaaaatgtagcagttatcttccctttctcataaaattaatgttaaaacttttgtaaaaaaacagatgccataaacaaagttaaaaaaatgaccaagtgaaagaaaatatctgcaacatattcaacagataaagaattagtgtcatacaactgagtcagaaaaaaactactcaaaagacaaatagccaaagattataaaggcaattaataaacatgcaaaaataaggtcatccttgtaattaagaaaatataaattaaaacaacagcaaaatttttttttctaaatttttggcaaaaattaaaattaaaaactttgatggtaacagatgatggcaaatataacactatggaaatgtatcctggtggaagtataaatgcatttaggtaataaagaggaggattttcgttttgtagttcaattaaaattcagaataaagcaagatgatggactagaaagtctcaggatcttcctccctccacagaaagtccaactagctgctatccacagatcagaaaatctattttgaaaaccccaatacttggaaacaagtctaggacacctacattgttcatagaactgagtgaagacaaattagaagagtaggaagaatggtctcactttgaccatgtcattgttcccactcctttaggttagcacaatgccagatagagaggagttccctggggtcacagtttctacagcggggaagagaaccaggggtagacatcaagattctcaagtattcaaagacacttctcaggaagcccactctggtctcatttcaccgggaacacaggaagtaatgaggtcaggtagaaacaaagaaggacagagctcacagtgaccagcatgtggattttggtagtgcttctgtgtttctgccagctatggcacccattcagagataccagccaactgcatagcccatctgcaaaactgagctggtcactttcagaagcatgttgggaagttcaacctagcttgagtttccagatggccagtctgtaagcccagcttcagaggttatgccagtgaccccacccaggtagcagacaccacctctgtgtatttcatagaagtgtaggggttaaatatgcttgacctgggagtctaaagggtagctcaactcagccaaaacctcactccatggctccattcacaagggtggggtagcaatcctctattatgcacatctaagaagtatagtatttatttctgcccatcccaagcaacaactctacctaacctcacagcccggattgtgaccctgcctaacttcaggtcccaaatagcagaatcatccagccaggcaacacatcttgtgactggcctgaccagaggccattgtagtacccagccagcagctccaccagatagcagagacaaaacagtgatcttgccagagagcaaggcccaaccagtggccctaccaaacataagagcaaaggcagtggcccagccaactagggaacccatgaaaactctgcctgctcaaggttgtcaccaactgatctttccagaattataggctagactaaatagcaaacctttatccctgccaaagaatacctataaaaaccagaagaagtggctttctcctcaaatgcacaaataatgcaaggacacaggattatgaagaatcaaggaatgatgacacctccaaaagaaactggccaagctcaaaaaattgacctcatagaaataaagatctatgaaatcactgacaaagaattcagaataatcctcttgaagaaattcagtggactacaagaatatataaatacaaaattaaatgaaatttgcaaaacaatacaccaacaaactgagaagtttgacatagaaacgattgtgaatagtgccacaataaacatatgtgtgcatgtgtctttatagcagcatgatttataatcctttgggtatatacccagtaatgggatggctgggtcaaatgtatttctagttctagatccctgaggaatcgccacattgacttccacagtggttgaactagtttatagtcccaccaacagtgtaaaagtgttcctatttctccacatcctctccagcacctgttgtttcctgggacatggatgaagctggaaaccatcattctcagcaaactattgcaaggacagaaaaacaaacaccgcatgttctcactcataggtgggaattgaacaatgagaacacttggacacaggaaggggaacatcacacaccggggcctgttgtggggtgaggggatgggggagggatagcattaggagatatagctaatgtaaatgacgagttaatgggtgcagcacaccaacatggcacatgtatacatatgtaataaacctgcacattgtgcacatgtaccctagaacttaaagtataaaaaaaaaagaaatagaaacaattatctgcaacttagctaatattgtaaaataaaaaataaatagaaacaatcaaaaagaaaccaaatagaaatcctggaaataaagaatacaatgactaaaattaaaaattcaaagtaagctcaacagcagacttgatcaagcagaagaatcagtgagctcaaagatagagtatttggaattatccaggcagaagagcagaaagacaaaagaatgaagaaagcctatggaaattatgggacatcatcatgaaatcaaacctttgcattaaagaaagtccagaagaagaagaaagagactataaagcacatttaaagcaataatgaaaaaaaagagtatagaatcagaaaaaaaaaaaagcagtaagggctgaaaacttccctaattaggggatagatgctagcatccaagtacaggaggcacagaggtctccagtgaaattcaaatgaaagaactgctcactaagacacaataattaaactatcaaaaatcaaagacaaaaaaaaattctgaaaagcagaaggtgataaagaaacatatcacatacaaaggaattccaatacaactatccatggatttttagcagtaacccggcaggctgagggagagtggaataatatattcaaagtactgaaggaaaacaaaaataaaaacaacatggaatcaagaattcttcatccagcaaagctgtctttcagaaatgagggagaaataaaacattcccagacaaactaaaagctaagggagtcgtcaacattaggcctgccttcaggaattactgaagggagttctttaagctgaaacaaaaggcccctaattaataatacaaaaacacaaaagcacaaaatttaatggtataagtaatatagagccatattcaaaatactctatgactgtaatgatggtatttaaagcaattttatctctagtacaagggttaaaagacaaaatattaataacaagcatagctaaaaataaattgtcaataaatacacattacaaaatatgtaaattctgacatcaacgacataaaatgtgtgtgggggagtgaaagaatgcaaagttaagttgttatcagcttgaaattgactgtaaaccccatagtaacagcaaggcaaaaatctttaatagaagcacagaacaaaaattttaaaagattcaaatcataccactacagaacatcagaccacaaaggaagacagcaaaagaggaacaaagaagcaaaacaaccagaaaacaacaaaatggtagtaccaagtcatttttaaattaataattaccttgaatgcaaatggactaaattccccatttaaaagacataaagtgactgaatggatttaaaaaaacaggaccgaaacatatgctaattacaagagactcacctaatttttaaggacacacatagactgaaagtgaagagaaggaaaaagatgttctaggtaaatggggactaaaagagagcaggggtagctatacttatattcaacaaaacagacttaaagtcaaaaactgtacaaagagacaaaggagaacattatataatgataaaagggtcaattcatcaaaaggatataacaattgtaaatctatacatatccaacattggagcacctaaatatataaaacaaatattaaaggttgaagggagagatatgttgcaatgcagtaatatcagggaatttcaacatctcacttttaaaaatggatagattatccagaaagaaaattaataagaaaacgttgaacttgaccaacactttagatcaaatagacctaatggatacatacagaacatttcatctcaagcacacaagaaacattctccaagatagatcatattttagcccacaaaacaagtcttagcaaatttaagaagactgaaatcgtttcatcgtatcaagtatcttttctgaccacaatactatgaaaactagaaatgagtaacaggaggaattagaaaaaattcacaaatatatgaaaattaaatgacatgctcctgaacagccaatgggtcaataaagaaatttaaaaggaaattcaaaaatatcttaagacaaatgaacatggaaatggagcataacaaaacatagcataaagtaaaagcaattctaagaggaaagcttataacaataaacaccaaaaaagaagaaaaatttccaataaagatactaatgatattcctcagagaagtaggaaaagaagaacaaagtaagctcaaaattggcagaagaaaggaaaataataaagattagagcagaaataaatcaaatagagactagaaaaagaatacaaaagatcaatgaaactgaattgtttttttaaaaagacagacaaaaacttttagctaggttagctaagaaaaaagagggaggccttaaatatataaaatcagaaatgaaagagaaattatggctgataccacagaaatacaaaggatcataagagactattatgcataagtatacaccaataaattggatgatctagaagaaatgaatgcattcctagacatatacatactaccaagactgaatcatgaagaaatagaaaatctgaactgacaaataatgagtaaagagattgaatcagtaataaaaagttttccattaaagaaaagcctaataactgttggcttcactgctaggttctacttatcatttaaaaagaatgaataccaatccttctcaaactctgccaaaagctggaagaggaaggaatactttcaagctcattttatgaggcaagcattaccctgataccaatgtcataaaaagacattacaaaaaagaattacagaccaatattcttgatgaatatagatgcaaaaatcctcaataaaatactagcatagcagctaagcatggtggcatacacctgtgggtggctgaggtggtaggattgcttgaactcaggagttcaagtccagcctggggaacacagcaaaagctcatcacttaaaaaactaaaccaaccaaccaaccacacgaaataaactagcagactaaatccaacaatacagtaaaaggatcatctacctagtcaagtgggatttatccctgagatgcaaaaattgttcaacatatgcatatcaataaatgtgatacattacatttacagaatgaagggtaaaaaccataccatcatcttgttagatggagaaaaagtatttgacagaattcaatgctcttttatgataaaactctcaccaaattagatatacaagcaatgttcctcaacacaataaagggcatgtatgataaacctatagcttacatatttaacagtggaaaattgaaagactttcctttaagatctggaacaagacaaggatacccactgccaccatttattttcaaagtagcactggaagtagcagcaagagcaatcaaacatgaaaaagaaatgaaaaatatccaaattgacaaggaagaagtaaaattttcactgttggtgatgacattatcttatatattggaagctcaaaagacttcaccaaagggctgcaagaacttataaatgaatgcaataaagttgcaagatacaaaattaacacataaaaatcagtagtattttctgttcactaacaatgaatgattgagaaagaaataaaaacaatcccatttacaatagctataaacaatatgtagaaataaatctaatcaaggaggtgaaatgtacagtgaaaattataaaacactgatgaaagaaatcaaagagaacacaaataaatgaaaaaaaatacaatgttcatggattggaagaattaatactgttaaaatgtccacactacccaaagcaatctacatattgaatgtaatccctaacaaattactgatgtctagttatggaatcataagtgtcatcaacagatgaacagataaagaaaatttggtatatacacatagaattccattccattttaaaaaacaagaacattctgctatttatggcagcatgattaaatctggaggagattatgttatgtgaaataagccaggtataggaaaacaaatattgcatgttctcatttgtatgtggaagctaaaacattcaaattcacaggagcagagagtagaatggtggttatggaggatgaagctggagtaaaaggaaggtggtgttcaagggacacaaagtctcagacagaaggaatacatttttttctttttgggatctattgcacagcatggtgaatatagttaataatagtgtattttatgtttcaaacttgcttagagaatttcaaatgttcccaccacaaaacataagtatttcaggttagcttgatttaattatttcacattttattcataaatcataacatcactttgtatgctgtatatatatacaattataaatggtcagtttacaatgtaattaaagaacaacaacaacaaccaaccaaacaaaactatgcatatctatgcatatgctctctgactcaggaatttaacattttggatctaccctagctgtacttgcatatgttcattaagaggctcttattataattaactaactaattttttaaagctagtgaatagttgaaaaaaccaatataggaagactaaaacactaagcagaattgtgatgtatttatattataggcttaaaagcaattccaaggaaagacctagatctacaatttaacataggtaaatctccaagacaggatgctgagtgaaaaacaaacagtgatttatagaatgaaacttatacagtttattatatgtaaatcacacatccacaaacatatacatctacacacattatttctaaagataaatggatggcaaagtactgaaaaatgttcaggggggtgacattaacctttaatgtgatgttctgtttttttttttaaagaagaatatatttttgtaaaattaggtaggcacatttgattatgttggtaattaaaatgaaatttagtaaaactatttgatgattagcccttacacttaagagatacatcaaaatgagtaactcagaaacggagaagtcatgataaaaggattgaatgataggtaatcagttcacttaaatgtagaaataaggctaaatgacaaggaagttatgtttttagggtacattttatgtgttacatcttggcaacagatgaatagataaagtatttagtacgaaaaacatactaaatttgtaggtagtcagagaaaggcaatgaacctatgtatgatgttgattcaatgttggtttggggtgagaatgcattgtgctgataaatttcttagtgtattaaatttttcctgtaagtttcttcagttccttctcaaatgtttgatagggcattaggtacgggataggcatcaaacagatattaatatgacaataatggtaaaggccatgacaacttttcctttgggaaatagcaatcccgttatcaaatactgttggctatgtaaaactcagtgttagaatgccctaaattcagccgtccatagtttgcattattaattatttaaggaaacatcccttttggtaatattaattttgattctacccactttctacctatgcccataccatacactggtcagaaagtcatttggtgtttgcacaggtgctgcaaaagatcaagactcagaatgcaggcctagggatattctgatcaaattacttggccttcctaagaactattttccacatttgtcaaatgcattgatggtgcttcaggtcttagatcacagagaaagtgtaggaataatatataaatgttctttgaactttaaatgttagactttaatgttttttaaattatgatggttgactcttacctgatggacaaagtagggagttgaatgttgtttccttctctagtccttcaggctttaggtaaaagaaagaaaagctagtgagaatggactgaccttcagaacatgtgttttaatggagggaccacagatatttggatagtgaagagaaggatttgaactgtattatctaagaaaattctgtacatataagcaatatacgtaggaggtagttcgatgcatgaacaaatgaaggaaaaattaagaaagtaaatcaaagggaggctgtgcatggtggctcacacctataatcccagcactttgggaagctgaggtgggcagatcacttgaggccaggagttcgagaccagcctggccaacgtggtgaaatcctgtctctactaaaaatacaaaaactagctgggcgtggtggtgcacacctgtaatcccagctactcaggaggctgaggcacgagaattgcttgaacccaggaggcggaggttgcagtgagcagagatcctgccactgcactccagcctggatgacagagcaagactctgcctcaaaaacaaaaacaaaaacccccaacaaaacagaaagtaaatcaagagagagataggacagagagatacatgagaataatattataaaatatccatatattattatattacccacatatattatatattattgtggactatatattatttaggtttacttacttcaaccaacagaggcttgatgactgtgtctttccttccgtgttcaggaactgaaggcacctcagtcccacacagctcttgagactctagtgcctctgcgctcacagtgaaattcacatttcctgaaaaaaaaggccagtagaaatgaatagcatcttccccttcctccatgcctccaaactcaagatttagaaatgttcaatgctctgtaaacttttgttttattaaaacacagaagcaggaacggaaacatgcaaatgagaggtgaatgatactgagaattcaaggtggagatgttgaggatatccttgtaggcatcttagaataaaaggcaaaggaaaaaaatcgcagcatctagtggtcttttcctgaaggaagtagcactcaatataaggttcccactgccatatacaatctttgagtagagaattatctctagcagttttttgctcacctaatgactttggggttactgcccaggacacagtttgccgcccgtttgcacagatgcagtgaggcgcttgttccttctccactgggacagctaggaaggcgggagaggcttccagctgcacactgacctgaaaccacacataagaaagggagtagagagggaaggagaacagagggagaatgggtttgaagtaaagcatcttgaggaattggttagatttcaggttgcctcacattaaagatgatataaatgaagatcaagtacctgaaatatatttaagtggatcttaatgtatcagatttacacaggtaaatctgagttattttggaagcaacctgctctttcacatgatgggaccagaggaagggaaaggtaatgatggcatgctgctctacctctttggtctggaactttgaccattcccccggatctcccggcagaggatacaagacttataaacagttatggtttcagcaaaggtaagatgctcacaaacgacttttaaaattaggtttaatataatgaatgagctacgaaaagttaaatatatgagatcgtagaggttgaaaccttgtagaatctgtcatgagaatagagtactgacttttgtcacccctgtcagaattcttcataccacacaaatactaactttgaagggttataagggctagaaacttgctttatggtgcaatttggtatttggagatctcaaaacctgtaacttttacaatcatgaatatctagtaagcatattttgcatacaagagtttgcagtattcctaggaatgcaacttttaatttacttgatggctaccttgtatttaatttaggaaagagatccttacccggatgcatttgggaaggtagtttaggaccgtggccttgagtgtgaaggcctctccacgaatcacagagtaaggcattgtgagctccacaaagaagggctggaaggctcggagagaggcagtggaagagataccaagtccagcatcttcagacaggcagaaggcccctgccttccactcggtgatggtgtcagggactgttactcctacctcagccacacctgctgagctggagaggagtgtaagtgaagaacagaaagtaagcagttaaatacatcctttctagggagagaatccctaggaatgattctactgccatgacttaaaaacactcaatagaaataccaataatggagagtataatcaaggattgagatgggaatataagtccttttcttccaactgtttttaattgtagtatatcagaattgtagcataatcttttacagacaatatagttataaatttaacatgcagtttgagattgttcttaagttctcttctctaaaatgctatttcactgagggctgctttataattttaaattctactactattgtgtatagtgggcctgactgaatctgtatttaactcaggattgctaaccagtgagggatctcttacaggcaatctgtgcagtccttggttgtattaggtccttatgcccattttctggaaatcttagaattaaatttgcacaaaattttttagctctgatgcaattagattagtaagacttcttagctgatgtatttatgttaaacatctcctgaaattagcaatgcgtttgaaagaagtacttcagtactgaaaaattagctaacagctcccagtttctccctggaagggcttcgtctacccactttatcagttgctgactgagtgttgggcttctaactagcctgcactgggaagcagaaggagcagggaaacgacagacttacaggaaggctgaaaagcagtaagggcacttcccatgcctccttcccctggctcgccccacggataaaaccaggtctgaacatacccctgggaataatttgtctatgcatcaagcaccccaatgtttacagctcgtacctaagggtctggctcctaaatcacctagctccaggagtagatggagctctgcaatcaggagtctccctagaccacagtgaacacagaggtggttttaaataggcctttgagcaatgccagtggctacccgcccccaccaccccttggctcaatacagagagaacaggcaaaatctcccatttctggctgtctcctaagggttgggcttctaaacagcctgcatctgggagtgaaagggagaagtaaacaagactccaggagcctgaaagggagtatatggccattccggctctttctctccacctgccccactggcttgtttcacggataaaactctgtttccagtgtctctctggaaggaatttgttcactccccttggtgcaaatgtacattgccacagccattatggaaaacagtatggagatacctcaaaaattttaaaatggaaactaccatatgtcccagaaatccctcttctgggtatactcccaaaggaaatgaaataagcaccttgtagagatatatgtgttttggtgttcattacagcattattcacagttgccaagatataaaaacaacctaagtgtctgggtgaatggataaataaattgtggctatgcgtaatggaatattattcagccttaagtggaagaagatcctgccacttgtgacaacatggatgaacctgggggagattatgctaagtgaaataagccagacacaggacaagtactgcgtgatcttacttgtatgtggatgctaaaagaagttgaatacataggaacagagagtagaaaggtggttggggttgcagggatgggaagaagcaggtcaaagggtacaaagttgaagttacgtaggatgaataaatttagaaatctaaagtacagcatgaggactgcagttgataatactgtattggatactgaaacttggctaagaggatagattttaggtgtgcttgctatgcacacaaaaataggtaacaatgtgagctaatggatgtgttaatttgcttgactgtagtaatcatttcactatgtgtatgtgtatatatatatatcaaaacatcatgttgtacatcataaacatataaaacaataaaaacagaaaaactagcaaagagttgaaaatagtcagggacctctattgttgcatattgcatatgcaggaagttacttactttaccaccaccaaatcccagatccatgtctcagggaagtactttcgtacggtctccgtgtgaggctcttcaacatgcaccaggcgtgcatggcctcttcccattacatctgactctatggtgagtgaggaagaagacattacaataaacatacagataaagcttatgagagaatgtaatagttgccaccaaaaaaaaaaaacaaaaaacaaatcgtctgatgaaatagagaggaaggaggagagggcgcttgggtcatcaaggaaagcttctttgaggaggaaatatgttggttgacttaacaagccaggagaggccgggcgcggtggctcatgcctgtaatcccagcactttgagaggccgaggccgagacggcgccactgcactccagcctgggcgacctgagcgacagagtgagacttcgtctcaaacaaacaaacaaacaaacaaacaacaaaaaaaaacaagaataagctaggagtgagctgggggaggagggtcataagcagaggctatagagactttggcagacagaggcttggattgtctgtggggcacaaggactctgtggagtcctatgtggctgctgccgctgtgctaagtggagagtgttatgacacaaggccgtgaagaggggcaggaatccaagtttccattggtgtgctcctctgcaggagcaaggaaaaactgacacacatgttatgacagtggctttgagaaacagtttacaggagggaaaagtttaataataataaagactttttattctctatcgtgtcagaagattacagttagtttccttcactctattcaccttctattaagggtgtgctggtcaatatttcacaaccagctctctggaaaaaaaaattgtgcatatatatatatatatatatatatatatatatatacctatacatgcataaatttactatatatcttactgataaaggattatacaatataatttataaataataaaatatgcggtaggcttcatagtgaattccatagagccaactgattctccttaaatgctttccttgatttttgaccctcttttctctgtactcaacttatcctcaatcatgatttgacaatatgggactataaataaatgcttgattactattcagttcatcaaagaagtagctcatgtcattgatgaatgtgtgtggttccaacataaatattggctgatgttttggggaagttgaacagcttttttacctgactgatggagaatgtagtgttgttgtgtgaacatttctatttctgtttacactaatcctacgcttggaaactttctctttcctttcagcctaacacatgtacctccatttactagaatttgagtttatattactatatgaccttgagcaataaccttaatatgtatgactcacatgtcctttttgtttgttaatttttgtcacattgtatcttttaaaaaatttaaaatttggtgaatatattaggcaatatatatttattaattttttgtttaccataaaaacctacacgtagaccttcaggtccatgcatttcatactgttgaagctgtggacacattttgggtttacgaatctttgagttggtgaatgcctttaagcccatgtcctgcaaagaaaattatcatctaatcagtaaatatatattataaaatatacataggtagctacttctttttattgaatttgacaagcaatccagttaacttaaattaaacttttaacattcacatctgtagaagggatatttatatacttaaggatgtaattttattcttttcattaaactctttcaacagtaattattttgtatatgtgattttaataaacatcacagagcaattaattcctgtgaaaaaagaaaacttgaataatactccaaaaagttccagcttagttcagcagcttttcgcagatctgctgctattagtagagaagccacttacctctttatatcccattaccctcaactaggacatgaaggcattcaaatacagactcttttccatgtgtaatattttaagaagcttaagatcagaccatctgcaacataaggagtttacctctaggaagctgtacatatccttttcatttgtacttgatactggagtatatgtgattccattaatatagacattatgacgattgatgcagtcttcattgtcctggtcattcaaaggcccagggaagccagtgaggtccttttctggtagcaggttgtaaacctgtacaaatacgaaagacaaaaaggcaaacttatttgtgacttttttttttttttttttttttttttttgagacggagtctcgctctgtcgcccaggccggaccgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttgtgacattttttaagttcaaggagaaaagaacaggaataatgaacatccgtctttctttgagcgctctcattgctttgatgatttatagagggtatggatcattttcttgacacagtgttttcattttgaagatgtttaacaattttaggaaaaaccaaacactccatctaagtactcatctaagtactaagtactacttcgttacacagttcagaggccaccactagactcaacactggaatgaaataaaactttattaattgaaaaatcgaggtctgctgtatttgtgacattgcacaaagctttgagatgatagaaggaaatgatagttttgtgcttatcttgtggtgagcaactgactcagtatatagcaaagttaatgggtgcatgttctaaacaggcacacgaataggaatatcctctctccacaggacacgatggcattttcttaggtattattagtggaaacaaaatgctccagatcttcatataatacatacaactttaaccgtaaaattctaggcatgatgctttcaagtccatttgaaggtgagaagtaagacagacataaaaattgtgatagttacattgcattatattcgtaggagtttaaaactgattgacaagaacagatgagcaaagtgagtggtgtgatgaaattagacactttctcaaagtatcttaacatttctcatttcctctccctgcttttattgtggcatattgcataattattgtctgtctcatctatgggacagacaatgtaagttccatgagacatacatttttatctttccagtagctcactgcttgatctctactagcacttagtataatacctagaacacagtgggcattaaataaatgtgttgaatgaatgacctacactagtagcagcaaagtgtttcattggtaagacactaatcaaagcttgagaagagttggtgttttaactcaggtctactactaaatccctgaaagcttctgctttattattaataaataggactgtctgccttatctacccatcagggttgttataatttgaaaaattctttgagaattataaaattatattataaaagtataaaacatgtatattattttcccacatatcctcttgagatcctactgttgaaatgtacttgatgcttcctttagaagtattctaatattttcagttaaaatcccattagaaggacaaacaagtaagaaacatttttttataagtttctatttcaggaaaataaaaatataaatttctctttgttaaattatggtagtagaaaaagcttcagtaagaggttattacaattggtctcatattaaaaatttgaagatgtgagcaaactactattagtacatgctattaactagtttttgttgttccaattcagcatatccttttggtatttcttctattagctccatattttcaaagagttcagttatcaatgtcaattatatagtagttcaatttccctaagttttgttcctcagagataatacatatgttccctcagaaattatgtgtagcttgggacagcaattatttcaactgatgtaattctttttttttttttttttttgacaccaagtcttgctctattgcccaggctggagtgcagtggcacgatctcggctcactcaacctctgcctcctgggttcaagtgattctcctgcctcagcctcctgagtagctgggatgacaggcgcccgccaccacgtctgactaatttttgtatttttagtagatacggggtttcattatattggccagactggtctcaaactcctgatctcaagttatctgcctgccttggcctcccagtgttgggattacaggcgtgagccaccaggcccagccataattcttataaaaacggaaatctgatatttcatttagcctgtatagcctcagtgcaggtatatgtatcacttttgttaggctttttgaaatgttgaaactagtttgacaactcctattactggttgcatggagctctgggattttaaggactttgggtactgtatggtctttttacattttaaatatataattttcgaacggcttccccggttgctcagttaatcctttcttttattttgcataactgcacttctcatatagcacttttcacaatctgctctgtattctctccagccttgcatatacggatgtcctgacacaatcagaagatttgaatttgtattgctatgtgctcttgagcaagaagcttaacgtgtctgaataacgagtccttttttggttgttaattttcatcacattttgtccttttaaaaattcttttatttgattcaatatattgtattttgtttatttttttaactgcagaagtgagtagttatatatatatatatatataattccttaccaatgaaagcccacaagagagctcaaagcaattaattcctagataaatataattttaattgatcttatcctacttatccagtcatttttccttgctctgagcccctggcacggcccttcttgattcctgaggctgccaggaactcaccgaggacgccgagagctcagcatcaggcttcatgagcagcacgctttggtccacagcacggagggcgcagacggactgaggagccgctgtgactcgcaggtgggcgtgtgaggctgggagactttgtgatgggctgaagctcaaatccacctgtgaaattggaacaaaaggtcagaaaagcaaatttccaggtttacccatgcattcactcgcatttgcagagtgttcctcatgtacaatgtataaccactctgcttgacttcgtggagggttggcattgtgtcaatcctgaagctttttgttccctacacttctctttcattctcaagaatcacttgagccagtagaattatttctaattattcttataaattactagtcatgaaatgccatttttatctttgatacacggcaaggtgctcattaattgtggtgggacatgcatgggtctaggtgctcttgcatttttcttttggctccttagtagtcttaaaaacttgcttacatatttcccaacgtttcatcatagaagaagggaataacatactctgaactgtgtaattggtaagaggcactgctaggagaagtttgagagttttgtataaggaatcaagtgattctgcttcttagtgtgactctgccactaccttgctgaatgtctctggggaatttgtttaacccttttggccctaatgttcacatgtgtaaaacaaatgataacaatagtaacttctagttttacatgttgaagattttatgatctaaaacacacaccttgttggccagacaattttcaacatcatattttgcagaatccccaatcacgtccccggtaggtaaaacagcatagatgagcaaccgagcgacaggagcaatgtctgacttcacagggattgagatggaaaaatggcccttcactggggcacaaagagaatgagaggaagccatcataggttaatgactatttccattagtagatgtaacagacataataaacagtagatgtaacaaatggatgattacctctaaggactctagctttagaaaaaaaccctatcaaagccctctctcctctcataaatcatatactctgttgatttttcaccagctttaagcttcagctcacccacctaatgttctgatgctagttaagggtatgaagacatccaattcactaccatttgatctaggcctcatactagaagagggaaatagaacctgaagttatgagatgtaagagtaagagttcaacacattgtattcatgctacatgctctttaaccttctatgagccaatatttggttctttctccataagaggaacaccatgctccttcagaagttattttttgatgcctatgtagattctttagaggttgcattaagtttccttcagtctgctatggtgcttctgtgttgctacaagaactaatgagagagtagattactgatacttttctagcaagttatcttttagagtctactagactaggagcaaccttcaaaggtttatattatgacatatttgctcatggcaagagtccgcttcagtcggtagaagtacccaatttaatgcttcataaatcataactatcttgaaagggaaaaaagatatttataataatataaatgacataaatgactcagcacaagacctggtatatacaacataccttgaaatcgtacattttctccaccccattctctaacacaattctcattttgagaagaggttcaagaatatttatggtttaaaaatctggaataagcatagattatacacaacaatattttatgtattttatttttccccctttgttcttatttatttatttatttatttatttacttttatagagatggggtctcactatgttgaccaggctggtctcaaactcctgacctcaagagatcctcccatcccgttctcccaaagtactgggattacaggcgtaagccatcatagctggcccacaccaatattttaaataacgcaaagaaaataggctgaaaaaaaagacaacacatatttgataaagggtgagaaaaaaaccattattgttttccctccctcaactttcttttaattaatattagatggaaatggtctctcgttacttgaaagtattcctgatattcccagctcaggaatggaaaaccaaacatcatatcttctcactcagaagtaggagctaagctattaggaagtggcagctaagctattaggaagtgggagctaagttatgaggatgcaaaggcataagaatgatacaatggactttgtggattcagggggaagggtggaagggggtgagggataaaagactgcaaattgggtacaatgtatactgctcgggtgatgggtgcaccaaaatctcggaaatcactaccaaagaatttattcattcatgtgaccaaacaccacctgttcccccaaaaacctatggaaaaaaagggaaagtattctgatacttccgtggtgtaaggctgaatgggtcagaatggggcagcaatgcagagatgatggaaatactcactgtcttcctgcttcacaagcagtccatgagtcccagttcggacaatgcctccctttgccattatctgcaaaaaaggaaataaaaagaaattaaatgtgccagagagaacacgcttcagtctcacttcaatatacttgttttattgagtccctgccggcaataattcacctcaagagaaatcaaactttcaaaaggaacatggataagaagttgaagtaatgacatctaaagagcttcatgattacttgctccacagagagcttttgtctacagtgaagtcaacgcagtaacctcccttctcaccagataatagaaggagagcttcttcagccccagcagggtgcctccattcagaatataatgtgcctggactgtctgagtatggccacagggtagttcatgagacatgggctcaaggtggacaaagctcttgcttggggagaacacaagataagcagtgtgatgtgcctcttcgtgttcttctgacacccactggtagccgtaacagggactacgatccttgtaattgacctaatgaattagaaaaattatattatttttagattatacgtcataaagattaatgttctcacaaaactacgtaagtttactgtcctaccttaactagtagctagaaatcttttgttccacaatgaaaagtgggagaaggacccctgattttgtttctctgcttcaaatgtaggcatgctttgtgactttacactgcagagcctcctgggattgagatttatatttcttaagagcataaaaggaggcatcctttgctctgattagcttgcttgaaatttctttgactgctttacctgtgcaattagagacactggagctatgaaacttcattgaggagagtaaataatctctagaaatggaagaactgtgctttcagaaagcagctgcctcttttagggtggattttgaatgggtattatgaataaataaaatattgtaaccttaggggtctgagaagacattggtagaaagcattggtttaagagctgagctgatgaattagctgaagtctacctcttctgggctatcttaggctgattgctattattattatttttttgagacagggttttgctctggcgcccatgctggagtacagtggcacaatcttggctcagtgcaatctctgcctctggggctcaagtgatcctcccagtcagcctcctgagttgctaggactacaggtgcatgccaccccacccagctaattttttgtatattttgtagagacagggtttcaccacgttgcctaggctcgtctcgatctcctggcctcacgcaatccacccacctcagcctcccaaagtgctgggattacaggcgtgagctaccgtgcctggcctaggctgactatttttaatgctccctgcaatctggattctaatacctcagaggccctatttgggttatatttccaacttttcttcctgtagaagttattccttagctcctttcaggcttcctctaccttcatccccagctcccaatagcactagtgaatccttgagcaaaacattttgttcatatcttaatgtatattttggtgacaacacatatatgatcaccccaaacagggaacaggtagaaataataatttcattgtcaagactagcacagtgctggcacgtggaaagcattcaagacactttttgaaatgagtaaacattcaaattagagggaggtgcttttatgccatctattaaagctaaataaataaaatgtattatttatttctctataacaaggtaaaactctaaagaggcaggcgttttccattaccatgattatgtaatatatattaaatatgtattgtatatccatgtatctatagacatgtctacatctctcttgatgaatagaggactgcatgctataccgaataacttatattggtatgaacaggtcatctggagaaaattagaatagcaagacaaaataaagtaaggtaataatttttggagtatatatatttaaaactaaatgctaattatgttagaattggcttttatagtaaaagtatctaacagttaaagggggcttactaagtgattcaacatgtatgatttcacttaatcttcacaaccaccccaagagtcaggtgttagtattgcaatcattttacagataaggaaatgaagcacagaggttttagttaattccttaaaatagggttgagccagtatttttaaccactttatctgattcagattctggaattcacacttttcaaaaaagttattataaacacacacacacacacaacataaaattaccatcttcattattctttagtgtacagtttggtagtattaagtatatctgttgtgcaacagatctccagaacttttcatcttgtaaaactaaacctgaataccaataagaggaattccccatttctctctttccctagcccttggcaaccaccatcctgttttctgtttctatgactttgactactttagaaaccccatgtacgtgaatcatacagtattggtctttttgtgactagcttatttcacttaccataacgtcctcaaggatcattcatgctgtagcatgtgacaggattttcttcccttctcaggctgcataatattctgttgtatttatataccacattttgtttacctgttcatcccttgatggacatttgggtagcctcgatctctcagctattgtgaatagtgcggctatgaacacgggtgtgcaaatagctctttgagaccccgttttcgattcttttgaatatatgtccagaagtaggattactggatcatttggtaattctattttttaattttttcaggaactactatactgtttttcatagtggctccgccattttacgttcccagcaacactgctaaagtctaacccgcacttttaatcacaatatactgccttcttttcataaactttaaaaaagttaaccttcaatcggtttctaattgctagtttttttctctccatagaactagacacagtttggaaattttctcacccttaggttgcaaccttgtttccaaggctacttcatgtcattggtaatttctttccaaacttaccctaacagtaagagaggtacccataacattggtggtgttgatagagaactgtacaaggccatgctcatccgtggtagcattggagtaatagtttgcttcatttcctctgatgaatatgactttatttggtatagggacgcctttcccatctactaggcgcacctgaagattaaaagctgtggattagttatattggtaataactaataggcaccaaacatattcatttatcacattttttagtgcctcctctatgttgaacatggttccaggcactgaggacacagcagtgaaaaaaaacgaagtttcttccatcacagagcttactgtctagtgaaagagatagatgctaaataaatatatacataacatacactaatttagtagtaatcaatcctaagaagaaaaacagagcagtgtgaagggatagagagtgatagggataataacaagagtgacctgaaaaatgtcttctagatattttggaagtgctgtgtattattatatataactcttagagagtcacagagcactagagtaatatgataatgaaatattttaatctattaatctattaactaaatttatttgtgccccaaacacctattttggagtggaccattaacttcctatagattagtgtctgaagtctcataagtgcacaagtaaacaattgccaatacattgtcctgtgtgtttctccagttgccttagacatggtctctgcttctcaacctagatcttcagccttttggaaggtaggcagattttatgacacacttcccatgtgaaaaatataaaattgaaaagaggcacacagtattaaataagttgccaaatctaatttactgctaatattgtattggcagttgagtagtccagttcagattgtaaaggtggcaattctttttcagtataagctacagttggtagcaggaagaacaataggctgacccccatcagtactcataattgatttacaaaatctaagtttgccagtgaaatgttggctgcatgtacaaagacaagaataggcacataattctgattttcttctagctagagagtcttatgacaaataggatatttaacagcaataaaatgtacttacaaagtacactatctttctgagaaatttacaaatgagctacactttcattttaggaagttgaatacattttggtgtcatgacataaccaagccttctagaatgtactccactttgttgagtctatgcctcttttacacccttcatagctgaaatcctgtaacatttacattaagaaaatgatacacagtaaatacacattgaggcacatgtaactgtgatctcagacttctagagtcataaagatccatttgcacatctgctgacaacagaaaaattgtaagagaagatttttttggtagataacatgaaaattcataattcaaaaatctgagaaccttaaatagcagtgttttaccccatgttcactgttttagaaatatacttgttatagaaaaatagtgtaaatatactatccatgaaataaacattattgtagaatctttaatacttcaaaataaaaattaaaaccacctacccacctgtttccatacaaagttagtgttagcatcgtaatgaaactggtcagcatgaattttgagattcttgtgagaaaatgtcataaaaacctgagactgcctggtaaaccatgagaaggagattgagtgacttgtacaatgctgtttcaaaagaaggggggaaaactctactaattttaataaggccttaggataattacatacatttcatacacaaatttacagaagaataaatctatttttatgtagttttatacctttggttatactaatcaagccttggtgatattttatacttttggttatattaaatgataacattaaccaggcatggttttagcacaaaccataactattgtgctaattaggtaacagtacatgggttgatgagtgaactggaaaatactccacctgcccaaagaagggaattccctgtcgaaagtgtgagtccactttcacaaatgagagtttggttatggttcttgtgatttcactggactgccttccagtcaattccaccactgaaaaaagagaaaaaaatctgttatttttgggaagaatgatgtctctaaaattctatcacctccccccaacttacaattcattatttggctaagaaaatcaatgcctgttgtgttttctcttatacccatgtagtacacaaacctgttccttcttcttggatctgggcctcagtgtgaagtttcatttcatactccttcctcttcagctggaagaccttggtttttacttgctgatagaagcagccatggctgtttagctaagaagggagaaaataaaatacaaaaatataatgcatattatactaaatagatcagtggtcagataaccggtgtgatttttgtggggggacaacatcatgtaggcattttctatgacgaggacacaataaatattctctagcaactaaatattaaatttcacaacaatatctcatgtataattgacagatgtattccttggtatctgaaattccctagatatattgcgatagaaatgtcttaaaatttgaggagtaattttttttgtacaaaggatgcataatatttatacatatttatggggtacacgagatattttgttacatgcagagaatgtgtaatgatcacatcgcgggatttagggtgcctaccaactcaagtatgtatcatttctatgtgttggaaatagttcaagtcctgtccacttgctattttgaaatacacagtacatctgctcttgaccattagaactcctcatcaaagtctggttcctcctccataatattcagctgtggctgggaagcggccttctatatggggactgtgtttgtcaactctctggcatcttggtggggccatgtgataggttcttgttcacagagagagcagaactgatggcctggccagctaaggcaattaagaggtgtatggttttttccttcctttgtagaagtgaatgcccatggaggctttagatggctcagtgtctatcgttctgaaacactcacaatgggcaattacgagaaataaataattcccattgtgctaagttcatgattttttttgaaaaattacaatagccaacatggaattctcttctagattgttctcttcctgcgtcagaaaaatgctgcaactcactgcttttcaacaatgcctttatcgctattctctagaaaaaatagtgttcaacctacctgtccactgaatttctcacagaaagcctgtgaatcttcaccgtggcagtcggaagcgtcactatactttctgcaaatgctcacagtcacatgtccagggacaggcttcccatatgtgtatctgtcatgagaacattcccaaaggaatcagagcagacactgaacctccccattttctagctatttatatctcccctttagctacagtatattccctgtctgtacttccctctgctctctgctgggctcacacaatattgaagacaagagtcactaatggctcttatagaaatctccattgcaacatgctgaaatttacattcttcttttatcatttcttttttttcctcgtttttttttagttttatcttaaaaaagtctttcttattataaaacttaaacccgttcttaaaagagaaacaataccagcaagacgaaacaaacaaaacaaaacagaacaaaaaaaacccaaacgccctcaagtctacctaggaatacaaactattagtacgatagtgtctcttcttccatcatcctctccccatgtgcagccatctctatatcgagtttcacttgtttattttattttattttattttattttattttattttatttttgagatggagtctcgctctgtcgcccaggctggagtgcagtggtgcgatcttggctcactgcaacctccacctcctgggttcatgccattctcctgcctcagcttcccaagtagctgggactacaggcgctggccaccatgcctggctaattttttgtattttttagtagagacggggtttcaccatgttagccaggatggtcttgatctcctgacctcgtgatctgcccacctcagcctcccaaagtgctgggattacaggcgtgagccaccacgccgggcctgtttacttttttacaaaagtgggattgtgtcgtaaatatgtcatagacaattgctgggtttccaagtgcatttgtctcctttcctatttgagaatgtcctctgtatgtctatttgcaagatcacaccagttatgaggaaccaggaacttggccatcactgtgagacagaactggagcaggggcctagctgaatagtaggtgtattacatgtgtgatctttggacaggactatacctgctcttcctgctactgctactgtgtgccaccatggatgggaacataagatccaggaaacaagacttttcaaggttggaacagactgtcttgagaaatcacgttcagtctcttcgtaaaaatgtcagtgcagacaggtatgtagacccgccttaggtggactagtgagttagatgagatttcagttgtatgcctatctctacaaattctgaatctaagtgatttttccagtaagcatgcaaggtcaggtaaatgatctgttgatgattgaatttcccctatagccatgtgttaattatctccctaatatacgtttggttatttttggttaaggcagaaccaatacccttcaacactatccacccttcccattttgtgtgtgtgtgtgtgtgcagttttgtcactttcagaatcaatcctattagcataacctctctagaaacagtttcttacctcatgatagaataatactgataagaacgtgaaagaaaataaaaatagaaaagcaacaggagaataacattctacagatgaggatgctgtcaaagcacttaaaatttttgtgttgccactgctcccggagagagtagttaaaatatcccaaatggtgagtctcttttaaataatcccccacaaaagatttttaaaaaatgaactcacaggccacacactgatacattcatctcttcttccaagatggtgattatctttggcactgttacttgtacttcaaacttgggaagaactgttgattggtgataaagaaggttggtgattggttttcaactttgggggaattcctattttcaggttccctgtaacagttccctaataatattttagggctctgaaaaggtagctctgctctccaatctattcttatctatcctcctctcaaatgaagatttcagttgagggactatgagagatcactgtgtgcttaattaattatggaaaactccattaaaacaagaatgttttaattttgggggttggtattaaatattgctacagaaaataacgaagctatgtgaagtcctattcacagatcactgatgtcctcattggacttaggtgtaattaattctactccaagcccaatgtcacccatgggaaatggaaagactccaaatgaacttaaattccaggacctaagagtttaaatatgaagaaaaataatgcttgatgacttttcatgatccataccaaattcctccacggtgaaagggtgctctgtccttccacctgatttcttctgtaccaccaccttgtaggagccctggaagggctctgatgagaggggaaaagaaaattgcttgaggccaccctctaactggaaactctgccattgtgcgatgcgatttcctttgggatcctatatgagtaaattaattataacttacaaaagcacctggagcattggagctaataaaagatatctatggaaaccctaagttatctacaaaaaggtcaaatggggtagtagtaaagggtgagtagaggagatgagttatagccatctagctctatgggagtttgaaggcttctcctttaatgacaagtttctgagatattgtaaaaacctctgaaataagaacattttccctatatgtattgctttccttttaatatggaatgtttcatgttgcttacctgaatgtatactagtggaatctgaaagacaaaagaaaaaagaagtttataattattttcaaatattcttaaatctcatttataagcaaagcagctagtatttgctagcataacagggtgagtatagtaaaaaataatttaattgtacatttaaaaataactaaaagtataattggatttgttcgtaacacaaagaataaatgtttgaggggatgggtactccatttattgatacaggcatgcaatgcatgataataatcattatccatgattggataatgatatggataatgataatgattatcatccataatcattatcatgcactgcatgcctgtatcaaaatatctcatgtaacccataaatatatatacctgctatgtttccacaaaaattaaaaacaataaaaagtttaaaaaatctaaattagtttcatatagaataattccctctatagtgaaatacagaaatattccagattaaattttatagaacttttcattaatctattttaagcaattaataaataatgttaagaacttactaggccttcagcaacaaatatacatgtaaagtgccatttactaaaaatggattaacatgtcttaagtgcttatagcatcctagtgaagatcaatcctttgctatgcaattttacaggttgagaaataaacacttatgtaactataagtaaatatgttcagatgtaatcattaagatgggtcatagaattcttacgtagttctaagaatgaggaggaatggacatatttcattaataaatttagtttaataaatattacttttaaaaatgaataaacattgataagaagctactatgaatgtttattcatttttaaaaactaatctttattaagtaccttctcatgcgctgtgtatcattctaggtattgagaatataaccacgcacaaaagaacaataaaccatgttttaatggagcttatgttataatagaaataggcagatttttaaaaatcaatacgtatagaatggtggtaagtgcaaatagaaaaacaaagccaagttaggctgacagagtgatgggtgtggtgcctcattttagacagaggagtgaaagtagaagctgggagaccactttgaaggttattgtaatgatcttatttagagatgacattgactaggactagcttgcagcagtagttcagatgataagaaatagtctgaatatattttaagccaacatgattttccagtgaagtggatgtgggtatgagagaaagagaaacaagaactaggccataatcttttgtctttggagctagaagagaagagttgcctctttttgagataagaaaatgtgaagaagttaatttgggagagaaaaatgaagactttgggttgatgtctgcattacaatagaaagaactgtttcttatcacagataccaagagttagtcttgaggaacaaattaattaccctgactttcctttatagtgaagattttggtagatgtgtatagaaaaaatctaaatctttaaaatgttttttgagcttaggttctttgaggatttttctgtgtctgctattgaatgtatctttctaattgtcctaattaagaaccatccgaaaagtaaatttaattgtgtgacaactgactgagtaccagcaccaagacagaaagaattacctactttctttacctggaatgatgttttagattaggatcttgtgctgttgtaatgccagaagttactgttaatgataccagattcttcctctccctggtcttccctcagcacaaaaaacaggttcccagcctgtttatacagacaatcattttatgtagataatagaaaactcaccaactcattcagggggtgaaagttttcatccatggagacaacacgaaatttcactgaaacagaaatatttttcatgagcccccaaacccaaagtaggcctgtaggctggtaagacaagctattaaggaaccaagattataggaactttgcctggggaacatccaggggaagaagatctttcctttttgaagttgtcctgtctgtaggcttcttcatacctgtctgccctggtttgtagattgatttgtctgtctggacaaagaccagactgtcctcgttcttaaccatcactgtggtccgcttcttaaattcttgggttggtcctttcacttggacagtgaggaacattacctcctcattggatgaagactttgggacctgaaatacaggaccgatcctgaaaccccattcagcacccgcaggtctcctcccctatttgctgttgcactcttccctggagatcttgcccttcttacttaacttcactcccttgttctcagcagggaaagttggcatggacaggaatcacttctgccattttacaaatggggagacaggacacaaggtggaggaaaataaatcagtaagagaggttgtaagtgagattcacaccttcatacagctcacagaaacagtcttgattcaattatacgctgagctttaccaggctgatattacatgctaaaagggcatggtcgaagcatgttttacaggctatggaaaaaaaccccgtattttactgacactaggctgtaagcatctcacatgtggacaactctgaagagatattacacctttgctcagggtaatttctacaatttttactcttagaagtagtgtggagtgatgtgttcctgtcagtccaccacgggtggctcatgttgagccttggtctagtttgctttattaatattttttccatcttaattttaagaagtcacattttctttttttttttttcctttctggctaatagggtttctatgtgattattaagctgacttttagtttgcctgtaaatatttgtctcccatggctggagagtcatgcattgctccttaatttctatacttagtttgctacatttggattccttcctgcagttcttaccaacctcccaaagcctcatctgacagaatactagatccctatgaccctgactaaaagaaccaagtatattaagtcaaacagccacactcacagcgaaggcgacacagtggagtacgtcattctccgcctccaggtcagtgaagaggctcctgtttcccctgacagactccaaggaagcacttacagtcactgtctcattcaggtagctcagaaggacacagcccttctcagtggtctcagtgtggagcagggaggggaccagaaccatatactgcctgggaatgagacggttcagttagaggaaagtgaaggaagagaggcattgctatcaacagcacttttttccatcatcataattatcatcatcagttctacaccaagagaagatgtactgatgagcatgaaatttggccgttgaaggccatgcataagaattatttcccttttccctcacatgccatggcagtgaacattttacttgaggtaggtcttaaacagattaaaacttgtaggcatgcttcactttaaggaacaatttgtgaacatctgaattcaaataaaaatatgtagttacatttgttcatgttgtaaaatctatttttaccttcaagttgctgtaaaaagtaagcaagctctcagtcatgcggacattacaaaaactaatcaaattatagaattttcattaaaatatatatacacacatacatacatacacacattcagcagccctgtgaaaattgtatggtaagcactcgcttccactccacagatatggaatctgagcctcaaagaaagtgagccattacttcacagtctcagttgtggtaagcagctaataaggtcttaagagtgttacctaaccatggatgtttgcattttaaatatttgcctttcagctcatgattagacaatggctccatccaaaaatggtcctctggtgattgactttagaccttggtaactcatgtgcagtacagaaactttctcagtaccctgacatgtaatttaagatcaaccctgtagtttttatacatttttgctcacagaactcctaaaataatttttggactctgtgcactccttacatattttcaagtaaacatatttttatcatgattttaagtaatagcaaaagatattatttttgatgatattttaaattaatacttagattacttttacaattttctcatgaataataaacactgtagtataagatacctactatcactatttaaaagtacattaaaaaattcttttaatggtctgatatttaatatctttctcttcttttttcctttttgaatttgaatttccatgccaattaccatacagaaatttatcctaaatttttatatttcaaaaaatgttgtgaattattcttacttctttattgtcaagcatctatacatatacgtatgtatacttatgttcacatatatacatatatgaatacatatacataaatacatatatatgtaacatatgtgggtaggtaaatttaactttaactcctcttttaaatagaatgtaaccataaatttataaatattaaacatttccttctgactgagctatgttcaaaaatacttgtatataactgatcaaaacaaaataaatacaaagtatgattcatacatattagatataaaattaaaatacttttgaagcacatctttaatgagaatgatgagctgttttttcccccagtgaatttatgcatccatggattgcaagaattaaacaacattaattctgttactatttttgttttgtgtagctataagtgctaagaagaatggctcacataaaagtaaataaatggcaggtaaaacaattgcatcattgttaccacttcttgcaacttctgcattacatgccaaaaatcacctagtactctattatcaagaatcccttctcatcactcatcagctggtatttccttcagttcctccttcagttgtgttgaaacaaagaattcatcaccacctcatctgcaaaaggatttctcttctgacattagagtcccttgctttttcaatatcaacaccagtatttcaaattgttcctttatttggcactctatagatttttatactccagggcattgttccatgtttggttgtgggagagaattgtctttatttttataaaatagaaaatggacccttgagaaagaggaaataagaaaagataaatagcatggtctcaagtagatcaatatgaatgtgaatatctaaaatttattcttttaaaaagctaaaaatttctgacaccccttaggaaggctttgcatattagagcttcagagagttggggaagaatgattaaaagtaagcaagtaatgagtaaactagatttgtaaaatctggaaggaatcttagagataagaagatgacagtatcataggaaagaaaaaggaatgatataaagaaaaatctgcaataaatgaaggactctaggttcatgcttcacgctctctgtgtggaactcacggttttccagagactgaggcgtctgtgggcaggaggaccaagaggagaagaaccagacttggatgaaggagtttgttcttccccatgttgcagaaagaaggagctggaggagaacagactgtattgtaccctactccctacaatccatctggtcccaaacacttcccaaagcaactgggctttatgctgctctgtgtgc

SEQ ID NO: 1361 - DNA, 158487 bp, Homo sapiens
agcaatcagcgagattccgtgggcgtaggaccctccgagccaggtgcgtgatatactctcgtggtgcgccgttttttaagcccgtcggaaaagcgcagtattcgggtgggagtgacccgattttccaggtgccgtctgtcacccctttctttgactcggaaagggaactccctgaccccttgcgcttcccaagtgaggcaatgcctcgccgtgcttcggctggtgcacggtgtgcacagccactgaccttcgcccactgtctggcactccctagtgagatgaacctggtacctcagttggaaatgcagaaatcacccttcttctgcgtcactcacgctgggagctgtagactggagctgttcctattcggccatcttggctcctccctgaaagctctgttttatttcttttcttttttttttttgagatggagtttcaggtgggcatggtggctcacacctgtaatcccagcactttgagaggccgaggtgggcggatcacttgaggtcaggagttcgagactagctgaccaacatggagaaaccccgtttccactaaaaatacaaaattagccgggcgtggttgcacatgcctgtaatcccagctactcggaggctgaggcaggagaatggcatgaaccggggaggcggaggttgtggtgagctgcattccagcctgggcaacaagagcaaaactccctctcaaaaaaaaaaagaaaaaggaaaaaaaaaaaagagacggagctctgtcagcaggctggagtgcggtggcacaatcttggctcactgcaacctctgcctcccgggttcaagtgattatcctgcctcagcctcccaagtagctgggattacaagtgcgtgccaccatgcccagctaatttttgtatttttagtagagatgaggtttcaccatgttggccaggatggtctcgatctcctgacctcattttctgccagcctgagcctcccaaagtgctgggattacaggcgtgagccaccgcgcctggcctatttaattcttaataatgctgtgacgtataggtgtatggtagagtgagagacctgggacataggtcttactggccctaaacctgtgttctttccacaatattctttgctgctttacaaaaagccagaaaggcatttagaaatctatttttaagaacttgtcatttgattatagtacaggatttataggaataaggggattcataaagtcttgagaattttaatgcagtcaggttggctaggaactcagccaatttgttttctttcctcaatttcttcttaattatttgtatttatataagcatctttactgcagaggccaaacctcttattcttaaattcatagtccactaccatttgtctgtaatcattcaagctttatcaaatttattatgtctcaaagcactccaactggaattgccattcctggaacttgttcttcttgttctcattttggtgtctttgttcatgctattctgtataagagagtgtgcccataacataaggggtaggctgtgagtggcatacattttcctgtctcctacagagactgcttgactccctcatctgtacgtgttaaaatcaccccacattccaaggcccagttctttaggaagttttcttcagtgtcttcaataggagtaaatctctctcagttccatttgcccaaggatcttctggtataatattgatcaaactttatattgaattatattgattaatgcttttttgacaaatagttaattcctaatatgtgtacaaaacctttcttgttttctccactaaatcatagcatattttaggataagagctcagtattactattttttgtatcccttaggctacagcaaaatatcaacacagtaaacatttaattgatacttgatttgatggtgagctggcattagctgactgtacttactaataccagattctgactggcttgtcttacattactcaggagcattattaatcatatttaagtgaataaatctcattatcttctcccctagaatcatacttcactgtccaagtgaaaagcagattattcacaagtcaatgcctgtattttagaacttctactctagtaaattttaattagttttcacacttgaaattgtcaaaagtgttcaatccagagagactccatcctgaatagggtctgggtaaaatgagactgacacctactgggctgcattcccaggaggttagacactcttagtcacagaatgaggtaggaggttagcacaagatacaggttacaaagctcccgctgataaaacaggatgtggtaaagaagctggccaaaacctgccaaaaccttccaaaaccaagatggtgatgaaagtgacctttgatcatcctcactgcttattagatgctaattataatgcattagcatgctaaaagatactcctgccagcatcatgacaatttgcaaatgccgtggcaaggtatggaagttaccctatatggtctaaaaagggaaggaaccatcagttccagagattgcctgcccctttcccagaaaactcatgaataatccatcccttgtttagcatatgatcaagaaataaccataaaaatagacaaccaacagctactctgcctatggagtggccattcttgtgtttcttttctttctttctttttttttttgagacagtcttgctccattgcccaggctggagtgcagtggcgcgatctcggctctctgcaacctctgcctcctgggttcaagcaattctcctgcctcagcctcccaagtagctaggattacaggcacatgccaccatgcctggctaatttttgtatttttttttaagcagagacggagtttcaccatgttggccaggctggtctcaaactcctgactttgtgatccacctgcctcggcctcccaaagtgctgggattatggatgtgagctgccatgcccggccgtgtttctttctttctttctttctttctttctttctttctttctttctttctttctttcttttttctattcacaaagaaaaagctccagtccatttttaaatttttttgaaaaattcctgactttacagtactaaactgaaatgtattaatattccattcttaacatttccatgacagacagaaaaattcatgagccaaaacaaaacaaaacaaaacaaaacaccaaaaaaaaaaaaaaaaatcccaggtagaagcttataaaactaaatatggatctcagcaccaacagctgaacagagaaaggaattaaaacactttaagtaaaaaatcacgagtggatgataaagtgtgtagaaactgaaaatttacaaactatttaaaacctgaaatcgctgactgttcagaaactacacagatggatcatgggtggtggtgaacagcagaaagggattgtggataaatctgcattgttctagctgctccccatgccacccgtctccgaggaaagcctgacattgattagatattgagccaggctaatgctggcagcagatccagtgatggtaacctgcctatcagtagatccttccactgggttcgcaattttgatctgtgccccagacatctgacggatctcatttattttggcgccttgacgcccgattatgcagccaatcaaatcgtttggaatggtaagttcatgagaagtagtctgagcagatgtatccaaacctgcactgaatccagtgttgccatgcgtcatgggaaaatgagactgttgcattgccaactggtgcagcatggtcaaatctggctgtggaatggcaaactgtccttgaagggtataggcctgaccgcctgcaaagatgaccggagagctggaaggcttgagctggtacgggatggtcacgcccttcgggggggactccaacatgaccacacagatctgtttgacacactcaatgatggattgtgggatgccagcaatagtgatggcctgctcagttgagttgggtagcatatcccctgccatctagacctgagcccctgtactctctcgtatttccttgatcttgcaaccaccttttccaatgagagagccacactgactagcagggaccaccagcctcagggtgactgggggtctagtggcagctgtgctactggtcatagagctgcttatgtcctcttccagtttgtcaatgatcatagcaaagcctttgaagacggcattagcaggtccagcaaaagtgataattctctcaggacaattcccttctgagatgttgataggtgcaccactctcctcgcgcatcttcttaactgattctcctttctttccgatgatactgccaacttcctttccatgcataagtagtcggatggtgagagtgatatttaatccaccttcaatcacactggtttccatgtcgagcagtgttctggggagctggactttgagtggtcaagtctttggtcactgatggggggtgaaagccaaaaactgctggcgcgaggcgactgaggggaaaaggggaatgggctggaaggggaagggcgggaggccgggggcggaacaataggggcaggcgggaaggtgagggggggccccgcgggcgggcggaggaggaaggtggggtggaggaggaggaggaggaagggggaaagagaccccggggcgggtgggggtgccgtggagggcgggcgggcgggagagggtgcagactgcggctgctcaagctgctctgggccggccttgtttctttactttttttttttttttttttttttttctgagacggagtcttgctcttgttgcccaggctggagtgcaatggcgcgatcttggctcactgcaacttccgtctcccagattcaagcgactctcctgcctcagcctccctagtagctgggattacaggcatgtgccaccatgcctggctaatttttgtatttttagtagagacgaggtttcaccacattagtcaggctagtcttgaactcctgacctcaagtgatccttccatctcagcctccgaaagtgctgggattacaggcgtgagccaccgcacccggccgtttctttacttctttaattaacttgctttcactttaccctgtgagctcatcctgaatttcttgcatgagattcaataactgtcccttagggtctggatcagaatggctttctggtaacaaaatgactgattgttttttgtcactgtgtcttaagacccatattctgcccttcatgattatcagtcacatgggcccttgttgcaccctaacttcatttctctagaagacagctcttctttttgggttccttaggaccccgccttcctcccctcatcaaagatgcagagtctgtggtttaggttgccattacttgcatgctatttttacatgaggggtaactgaccgaattttaatactaattagctgtgatataatacagacacagcaaattctgcccagggaggaactttgtaatctgactcaaaagcttcgtgggctaagcaggagagcatttaacattcactgctcactgatttgattccttagggcatttcacaatgaagtattgaaaattttcccatttattgtggtcttgtgacatttagaagggaaatggaaataagcttgtgagtatcctatttaagagttcttctctaattttgtaagttatgagttccctcacaaattttataaggaaatctagagtagtgttagttgagaagaaaatacttggaaagaagacacttgaaagtaatgcctgtgttttggggaaccacgatgaggaaattagctgcaatatgaccttgaaaggaaattttagcactttgtaaataatcaagttatttgtactgaaagagttccaacaaagaaaagaacatttttgatagtcaaataattcaaatttgaatgaatcacaaactagaaataaaaaactaaagaactggaaatgataacaaaggcaaaatataaacgaccttctaattgtttatttctctttaaaagacaatcaactgtttaaataaattatagtatcaatgtattattgttgtaccttagcgagttagagaaaatgccacactttgagacaaattaagagtctgttgatttagccggcggccaagagacggctaacactcaaagttctctggccccgaagaaggggctagattttcttttacactttggttcagaaaggggaggtggggggtctagttaaaacaattttacagaagtaaagtaggcaaaaaagttaaaaggataaatggttacaggaaagtaaacagttccaggtgcaggggctttaagactattacaaggtgatagacgcggggctttgggtgttatcaatcggatgaattcctgggaactgtggatatagcttgccacagtatcttatcggttaattgcattcttggatgtgctgggagtcagcttgcacaagttaagtccttgaggaaggggctgccagtgaaagagccaagatggagtctgtctggctctcttagctaagggagagtcaattcaggtggaaacaaggctaggtgattaaagtaaagggagagtctaaaaacagggttagtgaaaacaaggttgggcattacattatgatatttataacatatgtagaaataaaatatgtgacaatacaatcacagaggccagcagggaagaagtaaaagaatactattttaaagttctgatgtaatgtgaaaaatggtataatttcacttaaaggtagattgcagtaagttaaaaatttatacaatagttctcacttataagtgggagctaaatgatgagaacacatagacacgtacaggggaatgatagacactggggcctacccgagtgtagagggtggaagaagggaaaggatcaggaaaaataaccagtaggtactaggtttgatacctgggtgacaatctgtgcaacaaattcctgtgacctatataataaatctgctcatgcacccctgaacttaaaataaaagttttaaaaaattgtactttaaatcctaaagcaaacattaaaagaacacaacaaaaacatagctagtatgtaacaaagaaaaaaaggcagataaaatgaaataataaaaaaccctcaatcctaaaggcaaaaaaggacaaattgaacattaccaatagccgtattaaatgtaaatggcctaaaaatcccaactaaaaggcaaaaaaattgaaagattggagaaaaaagcaagatccaactatatatagcctataagaaacccaccttaaatataatgacccacacagagtaaaacttaaaaaaaaaaaaagatttgcttgctaacatcaatcaaaagaaagctggagtggctatattaatatcaaagaaagtagatttcagaacataaaaataatagtagctataagataattaattcacaataataaagggagtgagttttttaggggaaaatgatattaaacatttaagcacttaataatagagcttaaaaaatacacataacaggccaggcatggtggctcacgcctgtaatcccagcactttgagaggccgaggtgggtggatcacctgaggtcaggagtttgagactagcctggccaacatggcaaatccccgtctctactaaaaatacaaaaattagccgggcgtggtggtgggtgcctgtaatcctagctacttgggaggctgaggcaggagaatcacttgaacccaggaggcagaggttgcagtgagccaagatcatgccattgctctccagcctgggtgacaagagtcaaactccatctaaaaaaataaaaatacacaaaaccagaactgatagaacaaaaaggagaaataggcaaatctaccattttattcaggaatttaaccctttttcagtaattaatagtataagtgaaatacaggtttagtcactcactgctcatggagttcaattaataagagcaaagtctggtataaagaaagtgactctttattacaaaactagcttagcggaagtacagccttcctgtcttaagggtaccgcttcacctttggatcagaaagtggttgcttttaaagggggcctattatgaatggcacacaagggagaaagcaagcaggtgtgggaggtgtctacatgttagcttggtgccttatctattgggcagttgaattggcatcttcattggcagaaatattaatagattgtaaaggtgtccaaaaactctccaggtgggagagaattttgcatgggactttgggttgtaaattggcggctgtctcttcagacagtttcctggtaggttaaaatttcatagcaggcatattttaggttgtaagtcaactgttaactcttggatcaccttttcggtgggtgagagttctgctctagagcttctaagcacataattagatgaacttgccctatagggagtgtctggggaagaagatgtaaaaggttataattgcatttctaaagggctaaataggaaatagggaatgggggaaatggagaaaggagaaaagaagagaaaataattttttaaattgtaactctttttttctttaacaactgggttactcagttacgataagatgaagagaaaaaaacatctataagaatattgaagtcttaacactatcaatcaggttgaccttattgacctacaaagagcactccatcctaaaaaatcagaatacacattcttttcaatgtatattttatgtgtatttaatatatagttcacactaaatatttaccaagatagaccatattctgaatcataagttaagattcaatcaattaaattcatacaaagtatattgtcagaccacagttagaaatcatgaatagaaaaatctccaaatatttgaaaattataaagacatttctaagtaaactgtgtgtcaagaaaggaatgtagaaaatattacgaactgaatgaaaatgaaaatacagtatcaaattttgtgagatgaagttaaaacaaaacttagtggaaaatttatgacaccaactacctgtattagaaaagaagaaaggtctcaagtcagtaatctcagcttaagttttaagaaataagaaaaaacaaaataaaatccaaagtaaatactttttaatgttacagaacataataataaaaaccagagcagaaattaatgaatgagaaaacataaaagtaatagagaaaattaataaaaacaaaagaatttttaagattaataaagttaataggctttttggcaaccagtgataaaaataagagtaaatatgcaaattaccagtgtcaggaataagatatgtgacatcactaaagagtttattgatattaagaggataataacaaatattgtctcttaaaatatgtgaataaatttgactacttacaagaaaagaacaaataccgtgaaagataaaaattaacagagtttactgaggaagaaatagataacctgaatagtcccatatttagtaaaatagttgaattgtagttaaaaattttttacacaggaaactttagacccagatgcttcgctagggaattctatcaaacatttaaacaagaaataaagccaatgctatacaagttcttccagaaaattataaaagagaaaatatttttcaaccaattatacgatgccagcattactcaaacaccaaaaccagacaaagatattgcaaaggaagaaaattgcatgccaatattcctcataaatgtgatacaaacctttctaacaaaattttaattgatcaaagttaacaacatataacagtgataataagtcaaaaccttgtatgatttattccaagaatgcaaaatgagtttaacatataaagatcaatcaatttaatatgccagattattagactaaaaaaagatactctcatttaatgtaataaatgtattttatttataataataaataaataataataataataaataatacttattcttaacctaaaactctcagctaggactaaaaagagagtgcttcaacccactatgaacatatgtgaaaaacctacagacaacataatacttaatggtgaaagaaaattctttcttcataagaccaggaaaaatgtaagaatatttactctcatcctttgtatttaacattatatcgaaacttccagctagtgcactaaaacaaaaataaataaataaattaaagatgttgatattggaaaatagtagtcctgtgggaaatgtatggcaccaactacctgtaatggaaaagaaaaaatgtctgaaatcaatcatctcagcttacatctgttctttatttgcagacaacataatcatccaaaaaaaaaattctatggaatcttcaaaagatactagaataatgtgtgaatttaacaaggttgcaggatgcaagattaatatacaaaatttaattgtgtttgtatattcttggaatcaataattttaaattgagttaaaattcaatatcatatacaatagtgttcttacttatgaaatagagaataatcttcaaaaggtatgcaagacctgtaaaatacaaactatacaatattgctgagaaaaaatttttaaaacttatgaaaaggagagttatgttcatagtttggaagattcaacattgttaatatgtcaagtatctaaattaatctataaatttctcagcagtccttttctttttaatagaaattgacatgctcattctaaaatttatgtagaaatgccaaccactgagaatagccaaaaaaactctgaaaaaaaagaggcaacttggaagacttacatttcctgccttcaaaaacctttataaagctacaataatcaaagcagtatgatattggcatgaggataaaatatgatgagttcagaaatatactcacacatgtacagttaattgatttttgacaaggaaccaaaggcaattcagtggagaacagataggtttttcaataatgttgctgtaacaattgaatatcaataattcaattgaataacaattgaataacaacaccccactgcctaccttacatcatatacaaaaatgaattcaaaagaaattatagaccaaaaagtatcaagctaaaaatacacaatctctagaagaaaacataggaaattggattaagtaaagactgcttagatataataccaaaaacataattcacaaaataaaacattgataaattgaacattatcaaaatgaagaacagctcttagaaagacactattaagagagtgaaagataagtgacagtctgctagaaaatatttgcaaatcatatatctgataaagggtttatactttgaacataaaaatctttcaaaactcaataataaaaataatgtaatattggcaaaatatttgaatagacgctacatcagaaaatatatataatggcaaataagcacattaaaacactaaacatcaatttttcattagggaaatggaaagtaaaacaccatgagataccattgcacacctattacaaatatcttatattaaaaacactgacaacatcaaatgttggagaggatgaagagaaactggaactcttatatactgttggtggaaatataaagcagtaaaactattttttgaaagaatttggcgatttttaaaaaaattacataaattacatgccatttaatttgattaatagttgattttaaaatgacccttcctaaatggccatgtgaatagtatttgtgagccttttgcaagatgtctgttaacatcccctgctgtaatgtaaaaaacacatttctttaataatcttgcttcagaaagtctctcataaatagtacattttatttatttagacaaggagaattatataatacataatacttttcttttttactttgtaaggacactacgaacaaaatgtaatgtttcatgattataaatctcttaagctgtggttttcatttatctgttccctcagctttatggctcctcatgtaaatttgcagaaatccatccattcatccatccatacaccacctatcatgattgataggatgttcaactatttggaatgccagtagaggaaattgtgaagcaggtttactctgcaccagttgtttgcctgacttgggtgtgatagaacactcacacaaagttacatgaaccaaatttgttacttacagatagacggcaagggacaaccaaagcctgggattcagggcaagctcatcccccgaagctcaggaaagctacttaaggtgaacagagtcttatcttcaagtgctccacttgcaccacaggtgtaaaacgcctgccttgggctttgtaccccagtggccgcatgacaccttgggcaaaagtgctgaaggacaccctgtttctagggccaactggaacagagcctggactgttccagctacctcttctttatctcacaatgttccattcccagcacattctacaggtatccttgagaattacaagtgagaaagtggagagaattgggttggtccacttccattcagagttggtccactttcattcagagaactgtcctgcagacttgtttagaggtatctatttcagcatttctcatatcttcacttattagtgtctgtagctccaccatttctatctaagctcactctgaggtaaaagagccaggattttaatagagaactgacataccttagcttgggttgagagaataactgtagttgagcagctaaatcttctcccctgcttgccttctgcttggacagaggtcatgctcgttactaggtaatttatatacatgtaatctggaaaaccaaaatgcagtcaaagcatgagttatcatttggctagccatagaagaaaagaggagtatccttctaatcatctttacctttagaaagtctggaaaatgaccatttgtctgaataactaaactactagttttattaagtcttaaaagtcattttatgctgtaaaaacatattgcttttaatacattttagttatttttctttcttcatgtgagtgtagtaaaagaagcaggaaaaataatctaatacgtatctattaaacaaaaatgtttttctgcagttcccgagagatcccatgatccagagacaaaggtggcagctttggagcaagtggagagccagaaaaggatccagaactggagtggaaggtgggaaagatctttgagtgcagctgcactgtgtgggaagacaaatatgataatggacaaacagctgtttgaatcagacagtgaaacctcactaaagggagaaaagggagagcgttgctgatgagagaggccacggctacagttttgtgggtagaggttcagttatgagggctaaaatgcttagacagaaatctctgggttgaggctgaaagaattggagaccggcaactacaaatatagcaagtgtgtttcttcttgctctcaaaatatacttttagcactttggagtgactggtactatatgaacatcacacaatattgtagacaatctgagcttagtattcaagaagggtaaggcatacaatgatgatcaactataatattcttgatattcatgattttgaaatcagaacagctataccatttgcaaagagagagtccatgtgttttaggccagtgacaatgactgtgtttctttcatctgcatgaggcactaaactgaatgggatggagataaatagcctaagaggcttgatggcagggattcatttttttttcacccgagacagagtctcgctgtgtcaccaaggctggggtacagtggcaggatcttggctcactgcaacttccgcctcccgggttcaagcaattctccctgcctcagcctcccaagtagctgggattacaggcacccaccaccacgcccggctaatttttgtattttttagtagagacggggttttgccatgttggccaagctggtcttgaactccagacctcacgtgatccacccgactccgcctcccaaagtgctgagattaccggcataagctgccatgcctggcctgcagggattcaatttttaagccattatcaggatttgttgatctggttttgaggttttttttaaatatgatggtcagatctagtcagaagctactggccatgaattaggtgtattttggttatgcattgaattttagatatttacatgaatttaattgatggagacagtagttttatatatttagttttctgaatctttatcagggactttttcctgtaatttgagaaatcctaataaacgatttcacatcttcctcaaagtaacatagaggattcaaatagttgttcagatgatttaaatgttgtgattttactcagttgcctaacattttaaattatttctctttcttctcctttggcttggaaacagtggcaacagtaacttctaagagttgaatattattgaatcctttctctgatccacctactaggttcagtattttaaaaacacaaattatatagtcagataatctttgttggccttttatgcctattaaaatatctgttaaaaatatttcctctatttattttgatctttttgtcttttttctctgcattcagaatcattatcttctacctgttctctaagacagtgatttgatttttgacagtggctatcctggtccttgcttttataattgatctatttgatctatattggtgcttttaaattctcaacttattgtctcattctttaaaaaatcatatatttgggttctagtttttcttgaattcatatgcttattaaattcttttataacttgaacttctcaaaggcaaattgtcttctaatccttgggtagtttttctttacattgctttccccttataatattttcctttacttgtatttcttttctttatttctattctgattcctatttcttttctttttttctctttcctttcctttcttctcaatttaaaaaatatatgctacttcttttaatctagcatattttaacaataggaatttttcagaccaactttttgctctgatatagggtggatgaatatttttgacactgttaccactagggatgacacagaaaagacaatttcatcttttttttttttcactagattgaatgcagtttttccccatgagacaaaatatccctgaattttctttttaagttcctcttaagaaggtttcagaattcctctatagctcaaagcatcaaaggaagaaccaattttaatttgactttgctttaggtgaattaaccatcttcctagtcttttattttctttaacgatttgctgtctctcccatgcttcctccttagaacagctgctctctagcctacttcattgacagcaccagccaagtgaataggtcagagaagagaggtaaggaagccagctgtgtgggttgtacctccctatggagccagttaatgacacacggggctcaatccaccatcttctgcttttccctacaaactcaaatattctctgaacttcagctatcaccatcctggtaattacacctactttcacaactctagctctaatgtcatcctgagagtagctcatcttcacatgtgagatcctttcatagaatcaaagattattgcagccagaagctgagtccactgtgcctcatccccatcttgaagatgaggaaaacagaggactggcagaaggtgggtacagaatccagccatgttccttttagtccagtgttctttcatctcactttactgtatccactcttcaaactcaatatttcaaaatataatttacattttccctgataactagctctgcatttcagtttctcagtgtgactggcaactccattgtcttgtgttctcatcttctttttttttttattatactttaagttctagggtacatgtgcacaacatgcaggtttgttacatatgtatacatgtgccatgttggtgtgctgcacccattaactcgtcatttaacattaggtatatcccctaatactatccttccccactccccccaccccacaacaggccctggtgtgtgatgttccccaccctgtgtccaagtgttatcattgttcgattctcacctatgagtgagaacatgtggtgtttggttttctgtccttgcgatagtttgctcagaatcatggtttccagcttcatccatgtccctacaaaggacatgaactcatcatttttttatggctgcatagtattccatggtgtatatgtgccacattttcttaatccagtctatcattgatggacgtttgggttggttccaagtctttgctattgtgaatagtgctgcaataaacatatgtgggcatgtgtctttatagcagcatgatttataatcctttgggtatatacccagtaatgggatggctgggtcaaatggtatttctagttgtagatccttgaggaattgccacactgtcttccataatggttgaactagtttacagtcccactaacagtgtaaaagtgttcctatttctccacatcctctccagaacctgttgtttcctgactttttaatgatcgccattctaactggtgtgagatggtatctcactgtggttttgatttgcatttctctgatgtccagtgatgatgagcatttttttcatgtaaatgctcatcgtcactggccatcagagaaatgcaaatgctttgattcttctatattttatatatataattatttatcatgtctgttaaattttatgcttaataccatgtctcaccttcctttctttttaagtattactgtccctatactctgaggacgttatgtttatataattgcagtattctattttgcatccctgtttttgattttcatttcattcatataaaaatataatctgacagcaattgtataccaggcactatggatatgtggtgagatttcattgtaaatgaaggaagtaaacatacattaaaggctgtagatagacttgttttctctgcttctttccctcgtactctgtcttaaacctacctgactcaggcttttgacccatcacagcaccaaaactgttcttgctctgtttactcttgatctgacttctgcatggctaaatctaatggttaagaatgagtcctcctcctatagactaggtgtcatttagcaaatgtttctgaggatatgccacatgccagctctgtttcaggtattgaggctatgaaggtaaaagaaaaaaagattaaaaaaaaaatcctggcccttacaaagtttacattccatgaacatcctttgaaaaagttgatcatactctactctcttattaaatacttactttcctcactattcctttagatacaactctttaaacatttttaatttttaatatataggagtacaagtatggatttcttacatacatatatcatatagtggtgaaatctgagattttagtgtacccatcactcaaatagtgagcattgtacccaagaggtaactttttaatcctcactcccttccacccttccaacttttggagtctccagtatttattattctgctccgtatgtccatgtgtgcccatcatttagctctcatttataagtgagaacatgcagtatttgtttttctgttcctgagttattttacttaggataatggcctcaagttccatccatgctgctacaaaagacattatttcattattttttatggctaagtagtattccattgggtgtgtgtgtgtgtgtgtgtgtgtgtgtgtgtatacatacatacatatatgcacacattttatataaaaatgtggtgtatatacatatatatatgtatatgtgcacatacgtgtatatatctgtctcacattttaaaaatccagttctttgttgatggacacttaggttgatttcattactttgttattgtgaatagtgctgtgataagcatacaagtgcaggcatctttttgatataattatttcttttcctttgaatagatacccagtagtgagattgctggatcaaatggtagttctatttttagttctttgaaaatctccatagtgttccacagaggttgtactagtttacattcccaccaacagtgcataagcattccattttctccacatccttgccaacatctattgttttggactttttagtaatagccattctgactggtgtaagatagtatctcattgtggttttgatttgtatttctctgatgattagtgatggatacaattcttgattcttctacctttctggctgtttcttctcagtctcattggctgcacaagactcaccttctcaacttctaaatggggaagtgccgtactattcagtccttgaaccttttctctgcttctccagatgcatctattcaccatgtgatggcccccaattccatcgctttaagcactatttagaaacttgcctcagggctctcttttctcaaatgcttctgatcagcaggcactctttgaccacttgatcaagattgaacctgctcaccattttccgtcctcttgcccaattttattttttaatagaatttatcactatcagtttttacatatcaatttgcccatttattaattttctcctcctatcagaataaaagctccatgaggaaagggacattgttttgttcactgttctattccaagtgccccaagtaactggcacatagtcagcactctgtaaacattcattaaatgtataaataatgataatgagagccggaagggagggggcttatagtacattaagagtatatttgatgtgatccatcacattaacagaatgaaggacaaaaaccatatgatcatctcaatagatgcagaataagcatttgacaaaatttcacattatttcatcataaaaacttgcaacaaattaggtatagaagaaatgtaccaaaacaaaataaaagttgtatatgacaagcccacagataatatcaactcaatggtgaaaagtttaaagattttcctgtgagataaggaacaagacaaagatgcgcactctcaccacttctattcaacatagtactggagattctaaccagagcaattagacaaaagaaagaaataacatgcactctaactggaaatgaaaaagtttaattgtctctgtttgtagatgacatgctcttatataaaaaaatccctaaagactttatacaaaaactgttggagctaacaaggaaattcagtaaagtttcattatacaaagtcaacatacaaaaatcaataacatttttatatgttaacaatgaactatttgagaaaacaatcccatttagaacagctacaaaaagtacttaggaataaatttttttaaaaagctgaaagatctgtacactgcaaattataaaacatttttgcaagaaattgaagaagacacaaataaaaatatatcctatgtacctggattggaagaattaatattgttaaaatatccatactacccaaagcaatatacaaataaaattcaatccctatcaaaattctgatgacattttttaaagaaataaaaaaaaattctaaaatttgtatggaaccacaaaagacctcaatagccaaagcaatctacagcaaaaagaacagagctggaggcatcacactgtcagattttaaaatttattacaaagctatagtaatcaaaacagcatggtactggcaaaaacagactcatagaccaattatatttgtctattcacacactgctatgaagaaatatctgagtaatttataaaggaaagaggttttatagactcatagttctgcattgcttgggaggcctcaggaaacttacaatcatggtggaaggcaaaggagaagcaggcacattcttcacagggtggcaggatggagtaagtgcaagcaggggaaatgccagacacttataaaaccataagatctcgtgagactcactcattatcacaagaacagaataagggaaacagcccctatgattcaattacctccacctggtcccaccttgacatgtgggaattatggggattacaattcaagatgagatttgggtggggacacaaaacttaactatatctttttgctctggcccctcccaaatctcatgtcctcacatttcacaacataatcatgccttccaacagttgcccagagtcttaactcattccaacattaacccaaaagtccaaatccaaagtctcatctgagacagggcaagtcccttctgcctatgagcctgtaaaatcaaaagcaagttagttacttcctagatacaatggggatacaggtattgggtatagccattccaatgggagaaattaactaaaacaaaggggctacaggccctgtgcgagtctgaaatccaatagagcagtcattaaaccttaagttccaaaattatctcctttcacttcatgtctcacatctaggttatgctgatgcaagaggtgggttcccgtggtcttaggcagctctgcccctctggcttcacaggatacaacccatcctggctgctttcactgctggcattaagtgtctgtggcttttccaggtgcatggtgcaagctgttggttgatctaccattctggggtctggagaacagtggcctttttctcatagctcctctaggcagtgcccgcatggggactctgtgtggggtcaccaacctcacgtttcccttctgcactgccctcacagaggctctccatgagggctctgcccctgcaggaaacttctgtctggacatccaggcatttccctagatcctctgaaatctaggtggaagttcccaaacctcaattcttgacttctgtgcacacacaggcccaacaccatgtgtaagctgccaaagcttggagtttgcactctctgaagcaatggcctgagctgtatgctgaccctttttagccagggctggagctgaagcagctgggacacagggcaccatgtcctgaggctgcacagagcagagtggccttgggctgggcccctgaaaccatttttcccacctaggcctcctggcctgtgatgggaagggctgccatgaaggtctctgaccttttccccattgtcttggtgattaacattccattcctcattacttatgcaaatttctgtggcaggctggaatttctccccagaaaatgagtttttattttctattgcatggtcaggttggatatttttcaaacttttatgctctgctttctcttgaacactttgccacttagaaatttcttccaccaaatactctagatcatctctttcaagttcaaagttccacagatctctagggcagaagcaaaatgccaccattctctttgcatagcaagggtgacctttactgcagttgccaaaaagttcctcatctccatctgtgatcacctcagcctggacttcattgtccatattgctgtcagcattttggtcaaagccattcaacaagtctctaggaagctccaaatcttcccacatcttcctgtcatctgagccctccaagtctctaggaagttccaaactttcccacattttcctgtcttcttctgagtcctccaaactgttccaatctgtgcttgttacccagttctaaagttgcttccacattttcacatatctttatagcagcactccactctctgtggtatcaatttactatattagtctgttctcacactgctatgaaaaaatacctgagactgggtaatttttaaaggaaagaggtttaatagactcacatttctgcattgcttgggaggcctcaggaaactttcaataatggcagaaggcaaaggagaagcaggcaccctcttcacagggcagcaggacagagtgagtgcaagcaggggaaatgccagatgcttatgggaccatcagatcttgtgagactcactcattaacagcatgggggaaacagccacaatgattcaattgtgtccacctggtcccatgcttgacatgtggggattacaattcaaggtgagatttgtgtggggacacagagccaaaccatgtcaccaccggaacagaatggagagctcagatttttaacaaggctgccaagaccacgctgtggggaaaggacaatcttttcagtaaatagttttggaaaaactatatacccacatgcagaagaatgaaactagacccttatcttacaccatgtacaaaaaccaactcagaatggattagagactcaaatgtaaggcctgtaactatacaattactaaaagaaatcataggttaaaagctctttgacactggtctgggtaatgattttttttgggtatgaccccaagagtacaggcagcaaaagcagaaagagacaaacgggattatatcaatccaaaaagcacctgcaccgcaaagaaagcaatcaacagagtgaagagatgacctatggaatgggaagaaatatttgcaagctatgtatataataagggactgatatctaaaacatatgaagaactcagataacttaaagtcaagaaaataaataatccatttaaagaatgggcaaagattctgaacagacattttcgaaaaggtaaatgaaacaacaggtatataaatggtcaacatgtatatgaaaaaaaatgttggctgggtgtggtggctcatgcctgtaatcccagcattttgagaggctgaggcaggtggatagcttgagctcaggagttccagaccagcctggccaacatggcaaaaccctgtttttactaaaaatacaaaaattagctgagtgtggtggcatgctcctgcagtccctgctacttgggaggctgaggcatgagaattgcttgtacctgggagatgaaggttgcagtgagacaagatctcatcactgcactccagcctaggccacagagtgagaccctgtctcaaaaaattagaaaaaaaattttaaaaagaaaagacgaaaaaagaaaaaaatgctcaacatcactaatcatcagccataatgaggtatcaccttacctatcagaaatggctattattaaaaagagaaacaataacaaatattggtgagcatgcggggaaaaaacgaggcacactgttggtggaaatgtaagttagtacagtacagtcattatgaaaaccaccgagaggttcctcaaaaacttaaaaatagaattctgtcatttgcaacaatatggatgaacctggagagcattaccttaagtgaaataagccaggcacagaaagataaataccacatgatctcacttataagggtcacagtagcagaaagtagtggttacaaggagactgagggcagggtattgggtagatgttggtcaaagaacacaaatttcagtaagacaggaagaataagttcaagagatctgttgttcaccatggtaagtatatttaacagcaacctagtgtatatctgaaaatttgtaaaagagtagattttagtgttctcatcacaaaaaagataagaatggtaggtgattgttaggttaattagcgtgatttagccattccacaatatatacatacattaaaacattatgctgtaccacataaatatatatcatttttatttgtcagtttaataaaattgaaagctcagagaaatttccttaggtgggggtgacaattggggacattttacacggagggaacatgtgctaaggccctggggcaagaaggagaacatgcagtcaatgtaacagaagatgtactcatgtcactgaagtgtacacagtgtcggggagaaaagtagaaaaggagactgagcagataggcaggaacgtcaactgttcagaacttaaagatcatgataaaatgtgtttttttaattttaaattttattctaaaataaatacaatgtcattattaaaaaggtcttttaggactttttaaatggcacatctttcagtggagtcaggtactaacataaaacttgttttttctctctatgactgtggtcagcatactctgaacacgctaagtaaccaaagacttgagaaggctaggtgtgtattcagtatgacaaagatgcgaaaagaaacaaactgggtctgtgattcatttcttctggatctcagaatagaattcttcatgttaggtctttatctcaattgctacatggcttgatgatctgtatataagggatattgaacattgattaggccagtgaaagagaagtcttgttaaaggttgccagggtgaacaaagttaaaaagctaaaatttttaatcatgaaattagaaaggtactttttcttacccatcttggaagcagtggagccaagcagttatattcccttttacatttggcattctggatgtagtacctttccaaaagctatttatggcatgaccaaaaagagccagcttgtaatattttagttttaccaagagaactaatatatgttttagtttcagcaaagatagaaatcatggagattttggtccaactgattttccatttttttccgggaacaattagccacaaactgttgtatagcttttagggcaccacccaagggccaagtgattctcttcaaattgaaagcatatcattcttttccacatcactggtaccacagccaagtttctgggcttatgtcactttgtctaaagttccaagggggttgatttcacttcaaacatattcttgatctttcttctgggcaaccagtgtggtttgatcagattgactttctgtaaatacactggagaatttttgtggaacctgtctgttattgaaatgaagcatttgcttataatcatgttctcatatctttcagtacacaactggctcttcccttagttgctgttgtttttaaatccagattcccaactatctcctacctgacattctgtgagacagtaattttctggagtttgcatacttgccatgtattgaaaagcagtatttatccattgacaaaaatgcttgtaaatgcatttgatcaacctgctgaaatttcgatttttagagtcattttaatatggcattttcccttaaaattttcaggcctcctggcacttgtgcatttatttgtatttgtttatgtattcctaacacttaaatactttgaggtgtgttctttctgatcatacctgcctgtggaattctgtatagttttctcactccgtctgtaaaataattcaaccagaaatgcaaaggaaggaggaaatatgattctcttttttgagatttagctgcgaaggagttaaggaagaagatcatggaaagttggacagagcacagatgagtacagtaaaggatgaaaacccgtattcacaaaccatatggatccaggagtaaaaattgtgattattattattattttggctcttgtaacctgctgttatggaacctgaataccttttttttttgagacagggtcttgctctgttgctcaggttggagtttagcggtgtgatcacagctcactgcagtctcagattcctgggctcaagtggtcctcctgactcagcctcctaaatagcaaggactacaggcatacatcaccatgccatgttaatttttttaacttttattttgtagagacagagtctcgctatgttgcccaggcttgtcttgaactcctgccttcaagcaatcctcccacctcagcctctcaaagtgctggcattacaggtatgagccacagcacccagccgtgaataccttttatgaagtgcacaaaaatgatagtatttgtagagcacactgaggcaagctatggaaaagatttgaaggcatttatatagtatttggtgacatataattataaaaactaaaatgtaaaattttaaatgtagattttaccaaaatgtagattttgataaaacagcacaaattttgaagtacaaattttgaagagcttgcttctgtttctattttagagagttacacaaaatttctatttcagtgattatctgtccaaaattccaatagatgccattatcaagaaattgtttacccaaatagttaataaagttaaagaatattcttacaatcatttaaagactttgacaattgaaattatattttgtattttgttataatttttcccctttcattgacaaatgtaatattaaagattcttgcaataatataagttgattttggattccaatttgcctttctcacatcaaacatttcaagttgataaaatttttgaacaataatctgtaattattatgcatacattataagagcagtcaccctacagcaatcttggatgcctttaaatggtaaattagccaaaatgcaaagatgaatatttgggaacatcacttataacattaattacagaagccccaaagaggctcctttcttcccccaccctccacactagcactccctggacacctgaaacaggaccgtctccagcagccctctctacaatgcagcactggacaacagctgttgaagtgggtgccccgggagaacagcacctccttggctcactcagagcagagcagcaagtgctgggttctcctccctttttgctgccagcaattatcactggatacctctttagagccacttctcctggggtgacctcctaggatcttcaaatcaggctgctggtcataaaaaatattttgcctcatttcctatacccctaggtcctggcttggccactaagggctgagttgataacttcctttcagaaatttgtagtttatttccattagtgtgctaaagtacagggattgggccatttctttcttataactagtagtaccttctctgtggatggaagtaagagggctcctaggcaaggtgcctgcaaagttatgccagtttctttgagaatatagagaatattctcaggatatagaatggaaaattgaagtcagatctaggacaaaaattccaggacgtaagattgaatttcagggctctaagcaacaagatgcttcatcttctatatgccgtgaatactaccattctctaccagtaatagaaaagacattgtcagcatctgcacccatctctttctgtattttttgagttatctggcatttccatattttgctgacaggccaaggtgaaagtccccatcgtttcatacctggacatccctacattgtaactctgcatgctcctccattccccagtacgttgtctacactgcagccagactgaccttttacaaatgcagaccagattataacacaggctgctgaaaacctttcatatcttactatttttcttaggaaaaagaacagaaatccttaatatggctttaaagtttttatgttttattttctgcttaattctccagccttaaaatattctactctcctctggctgggcagccatggtggcttctgtcatgtcctttaacatggcctgtacccttcttggctctcaccctgcccacagtctccaacacatattcacctttcagagctcagaacataggccatctagaaaaatcctcagttgagtcaggttctgctgttttatattttcaagacattatatacctttccttcaggacacattacagtttataatcatacattcataagtaccatcatttgtttaatctctcccactccctactgtaagctgcatgagagcaagacatttgcctttttttgttatttattctagattgagaactgacacttagtaagcacatgaccaatggctgatgagtgttgctgaatatctgaaaatatgggctcataaaaattctaccaaacccaaatcattatttgaataatttggatactgtagaagcattctgagaagaaataatgccagtagcatgaaatatacttaatgcctatttgaaaaatcttcaggcaacactttcctatttttggtttagattttttaagggaaaattaaagctattacttaagtaattcagatcacggatttttttaaaaagtgccaaattccactttgatgtgagattgataatgacaggtaggagtaaagtgaatttgttctatatgacccgaataattgtgtcagttatccatttaacatgtggttgtccatgtaatggtgtgttggtgtgttggttgctttacacatgcctgaatatttaaggaatcctccagggtgtctgaatgtaattaaagtatgacataagcattttaaaaaaatgaaatgattaaatctctactttctcaatgacctcttccatgttaacaagattacaattagggatgtggaggatctaaagggcctttaagttgaaatctatcaagcttagtagccatgtagcctggctgacgggctgagttgattgttggcttaagttgaacatggcataaggattgtgctctccttttccatagtgctggggttttggaggactttggtgcactgatgccttctgattgccttgttctgcttcctgtcattgttaacatgggcacgaggaagagagagtaactcatatttgaattaaagaccagttcaaaattagaacagatacctattacaaaagatatggccttggggattggtgagagatgcagagatgagggaagcataataccaaaggaaacgaagcatctggagaacccaggaactctttggacaaaagtctttgtatgaaagcagaaactaaacattcgttcaagggcttggatggtccaaagaaataaaacataactacctcgagaaatgagaggaagaaaaaaatgtgataatctctaagtccaggttaaaatatcaaactatgttcgtgtggctcagatgaacgttggagatgaaaaatattttgtcagaagccgatagatgtggaaggttgtggtggtggtgagcttcctttttcagcctagctccttgttcagctaattcagtaaaaactgcttggggcaaagcctaattggcaaaccggaaaattgggcattttgagggcgacttctgattagtctggatctccacaattcaggctctaaagtacttagaaggtgttttttaattctgagtgatgatcaaaggttaccaactgtatgagaattgaagtttactttctaggagttcagtagtaggataaagaaggtgcttaatagagttgcagttagagaaatattagaaggtataattcaagagacaatgaaattgtgtaagtctgacctttggtgttgattcttctctgaaaatggttgcaatcaaaaacagcaaagaagactgtggtggcccaggaagcagaaaattgctggaaaaagaaaaaaaaaattggtatcttgtttgatggcatagacaggagctccatggttttccagtagtctgatgggagagagcattttacttgaaaaaaattgtgaaggctttttaaaggaaaatccccctccagttcactgttttattgaacgaggactttttgagttcctcttatgtcagccagtgtgttggttgctttcacacagatttgctcatgaaactaatttactgcctagcatactctttcattaaaatatcacataaacgtttttaacaagtttaagtttttggcaagcaacttatttgatgacagaggctctatgctgttaggccacggtaaactgttaaatatattaaatgagcactttcatagcagtttactcattcctttattccctgactcagcaaatatttattgaagccaaacgttaagagccaggaagtatttttgacattagaactttcaaagtgattgaaacaagcagagaggggcacttagccaggttgcagataattactttcaggatggttttctacagtaggtgatgcctagggtgggggagtgttggaagtggtctaggaggatggaagagtaaaaggaaggtatgaaaagaggaaacagcaaggggccagccttttgcattccagtatagtgttagtcataggcttcagggctctccttgagagcataggtacttaactttcagagagcttactcctgtcagctgagggcaattctttggagaaggggagctactggaagccttttgcagccaacactcacagaagctgggggtggtgcattggcccagtacaaggtatctgagtggtgcaccaaaacagcgttggccaaccacaagagtgactgggagatgaataataaatatatcaatggtcactcctctttgacaaagcttgaatagggatgtttccccagcaacatccttagccctgtgctcacaactgttatttctctctaagcaaagtccactctcctctgctgcaactcagcaccaccttctgatgtcctcatgactccctcacccatgcatccagccaggctttctccaaataaatgtttgttgaatggataaatatactaggaattctctgactgaagaaggagaaaacataattacaggcacagaaaagagttgttcgaaggcatgttcaaaagctaggacaatgaatttatgtcatagtggaagttcaggtctgttcagaatgaaaaacaagtgaaaatgtgctggttgtatctgataataatgctaaacacattttttttcctaaatcaaaacagttatttttgttcagctcaaaatagactcccaagaatactcccctccttacccattgtttccaagagagaaaatctgacatatttaatcaatggactgaaaatgaagtttccctcttctctcccaggcagtgggctgctgctctttctggatattggggcaagagacaagtcaggcttggaagggtgtcctaatatttgcaaatgtccatttttctgtccaagcacagagaaggtaaagagccaagaggaaatggttaagagggctatcttggcaagccttttactccagaaagaggaaagaatcttcagaaaaaggacaaaagtgcaaaaagatttctctgaaaaaaaaaaaaaaaagaaaaaagggcaatccagcttaaaaaactttgatgataaggaactctctagggatagatagctagcaaaaaacattcgactgagcttcagaaacaagttctctggaaactgaaggacaaaacactggctggacattcctggcagtgagctacggatggcataacatagcaactacatctccttagccatttgttctagtttgctctacattaacaattcacaacaagaagagtggaaagtgttaaggagctaccatttagtgcctctgacacctcagctactatgcaagttgtttcctgtagcctacttcatttgatcctcagactgacttgctatcttctttgtaaaaatgaggaaacgagagctcagagattcaataatttgcccagcttcatatatttattgagtggcatgtgctctcatctatgcttaaatgtaattatgtgtacttaaaggcaaatatcgttctccattttccacatatccaagattttagggatgatagggtttctctgagttatggttggtaataaaaaagaaactttttcgtattagagtagtttgaggatagagcaattatcatgtaaggtatactgctcagagtctatgcccacctcattcaggccactctaacaataaacacaggccttttggcctggcgggctagatagtccctgtgacagccagactcctcatttggttatctgtggagtaggagggaaattaaatatacatctgcatcttttccaacaacaaatcttaagagattattgctagttatagcagcaatggtttctggtatagaagaataaatagaaaacaatgtttggtgtatttgaataattagttctatccttttttctgaaagctttgagagttacttgatttgttttttattcttttgacttgaaattgagaggcatatttctacttttttgattcttaaacatttaagattcttctaccttttatgacatagaggtttaatataattacctaatcatatatttacctgtttaaggtacttcaacagctgttgatgtgatggtttctgtgaattggtagaaagattttggaccagtagtaataacttctcaaaaaccctctgtcttagtttgggctgctataacaaaaatgccttagactgggtaatttatcaatgacagaaatttatttcctgtatttttggaggatggggagtccaaggtcaaggcaccagcagattcagtgtctggtgaggacttgctgtgcttcagagatggtgcctacttgctgcatcctcacatggcagaaggggcaaatgctgtgtcttcacatggtgaaaaggacaaacatgctcccttcaccttcttttatatgggcacaaatctcattcatgaggccctcatgatttaataatttccccaaagatcccacctcttaacactattgcattaagggttcagtttcaacatataaatttggagggacacaaacatttagaccatagcagcctccttattttacttaggagtatatcaagcatactcagcaagagaagctgaagaggatgagagccctctagcttagacatcacaacacctctatgaggccatttttccactcattgctcctttgcaggcgatccttatgatctgggcatccctccccttgagctgactgtggctgtcggaggacgtattgatagtggcttctcctggaccacagcatgactgcacaggtttctccaagactctcgccagggagatccagaggagcaagtttggtctcagggtgccaccagcaggatgtgtggccaccagagcctgcgtttgtgattggggcttattatcctatagtggccccgcagtttctttcaggggagagcctgcttggcccgtgtctctccctgagtgctatacttacctctcatcagctcatttattttccaaatcttctctgaggtgctgttatcttacctagggattgaaaaaaaaacttacttagggagaaaaaagttatattaattctggaaataaaagcattttaaacttcaggcttaaaaattataatttgctgcatatttgaaagtaaaacacatacaacatctaaatgtaaatatatttggtatgactttaatgttatccttcaccaatattctgtatgtaattctgaatatttaggttgccagtgctagcctttccccatttccctgggtgagataattatcatgggaactggaagaaatattatacatggctcttttctctgaagacaaacttcttatcttggcataatcagctcgtgttgatcggacccctacctcactgtttttataatagtctctgttttatgatatagccaatgactcccaggctgtctctgttttctggctctcatctcaccactcctcactagtctggttcaaccttcaggactcaactttgataattcctctcccatgactatatgatatatcctactcttttatttgtttgtttgtttgtttgttttgagacagggtcttgctttgttgcccagactgtagtacagtggcttgatcatggctcactgcagcctcaacctcccaagctcaagcagtcctcccacctcagttttctgagtagctgggaccacaggcatgtgccaccacccctggctaatggttttcttttttgtttttttgtagagacagggtctcttcatattacccaggatggtcttgaactcctgggttccagcgatcttcctacctcagcctcccaaagtgctgggattatatgtgtgaaccctttccagcacacatcccactcttaattcctcattaggtgcttctagtgtacgttactctccattgtgacacccctggtggtagttcttaggcattatgacttgtcaggcacaagtaagaaaaagtcagcactctggtaccaggtactcacaagctacttttgttgttgctgttgttctggcttattcccattccctaatcacaaggctcctcctcagaatgccatcttaccttgctaaatgacggcagagattgatttctagcattgtcatgtcacttgcatgagttgtacttgttatgcgtttcctaggctcaatgtactactagttctgttacatctgtttaggtatttgtttgcatgtgtactgttcattggggctgcactcagcattgatgctgagtacgctaaagatagtaacttagttctaggcttatattgttgattgtcctgatagatgtattggtatgcaattggctggttataaagacattcagagatgtaactatgagcctttgactactacaaggatgaagaacataatggagatataatgctctgtaaacttaagaatggtttgtacatttctaagttggttaatgcagtctttcattggcttattcaacaatcactgggcacattagatgtaccgagcctcttttaagagggagaatgaaagttaaattaatagtttctttcctcaaatatctgggagcctaatggaggaggaggaggacattaagttatttcagtaaggtggagaggcttgattctcattttactatctattctaacacttgtagaaagcatgcttgctcttcagatttaggcttcctgaaatgtagggagggcatgctattggagaattcaggaactagcaatacttagaacaggcattcaggaaagagatttcagtttaggttggagaaagggattgaaaagacttgccagttcccagaattagaaagaccagattaccagtgtattagtaagctattaattgaggcagagacaacaaggcagaggtttacatagacaacctatgcccaaatagtcgggccaaaggcaggagaaacttgttgctgacatcatgtagtatttgacagattataacccgtcacctgtatctttacttataagctgtcataatttagaactcttgcaaaataatttcttaatacattcttaatacattttcaccttaaatttttttttgagttttactatcgttttcaagtagcagcagcaattattgtaatatttactcagtgcttaatcttgggatgagtccccttggggacttatatggcttaatatagtcaaaattacacttttgttaccatgagtgagtaaagacattatctttaaggaagcaacatcatgtaatctgttaatacactgctcttattcaatttataagaccactgtatacaatcaggagacatctaccactacttcataggtatcgcaagacagaaacggacaacgaaatctgaggggtccatagctttatgctagtcatgctagattcactgagattttggcagggcaattgattgattgattaattgatccactctttcctcaattatttattgaatgtcagatatggacattatgtcaggaatatggcttatttttattcaaaagaaggaaaatgtatattcattagtctaatttttatctaataattccatgaagaacaaggtaagttacagtgaaaatgacttattaggattttagagaaatttggggggttgggggtgaatggaaatgtgagaaaaagggagaacagcataccaaaagggtattatggtctcatttgactgaatacttataacagttccacaattgtagaattatgaaatatttatgggtacctattatgtgcaaatcactatattaggtacagaaagcacaaaaacagatttttttttttttttaccgtcaggaaggtttacctctagtgaattgcattaaacatacataaataaatataacatgagatgaagtttgtcaggtgtctaggagatatttgaaagagtacattttcagctctttgggtatttggaggcccaatggagatgtcatttgcactggtccttaattactggataagtttgggatccacagatatagaaagaaagagaattacaagtgaaaggagctgtaagcaaaaccataaagacaataaattaaaggacatgcacagaacacaatttgttccacttggctagagtcgagggaaataaagttcgaaattcaaactggggtcatctttaatgccaggctgaagaatttgacctttatttaataggcaatgaaaaatgttgcttatcaatgtcaacacgtaattcgtggctggattacgcagcaggattttatcaatctatgtcatcatgacctctgaaatccaacctttggtcaggagcatatattgatgtctaagaactttaggattaacttccccagggaaatttatagcacagctttagatttgattctttagagaatttttatttgaggcaatataaaagtctgatgtgtgttgactacaagttttaaaataaatggtggaatgcttttggtttgccaatttctgaaaagtaaaataatgacatattaagtaatggaaatgtgggaattaaaactttcacagaaagagcaaacaaactcatcatttctttccttatctctgtttctgtgtcaggcccccttcctggctcatgtcttgtcctccaagatgtcctcagttgcctctatttcagttcttttttctttccatgaggggtgagacaccattttagaacttagtaagccacgcttggcctcagtgtccgaaaataattggagtaatttcattttgtttcttctagagggggatccagaaggttcagaagttgacctgttctttacttacctttctgtagactttaccttgttccaagtcctgctgggatgatagcctttaatgtatttatcactgtgtggtgctccaataatccaccaattctgcaaatttttgtccttgaatttaggatgcttttacattttttctcggaaaacagttttaccagctggcagtctgagttaactaagttccatatataaatttatgcaggaaggagagggagaagaaaatatgcaggaatgaaaacaaatatttgaatgcagtgtaatagctcaaagcgcgaatccaagataggtcaagttagagtgatttttaaaaagatcttcaaatttcagaatactttatgatattctctgccaaaaactctgggttttcatcagtgtctttcaccattttatggctcttagtggtgttttgtggtccataaatttaatatattgtccatgctacctatcgtataccctgagataaattcccagaccacattggcacactgagagcagcacattaaatgcctctccctgatttttcatgccctttccatccatcaagcaagcctatacaaaataccttttatgtgttaacatgctagatactctatggcaccacttttcagaatttattgtgataaaaatgaactggaggtatattatgatgcagattctgaagtctgggttgggacctgaaggtctgcatttctaatatgctcacagctatgttggtagagggaccacactttgggtggcagggctctttgggattatctttaataaagaactcataatataatggggtcattaggcacatcaaaagcaaatataaggcaatctgaatacagtgatacacatatttcattgagaatagaaaggaagaaaggattcattttgtggagagtaggagaaattcagaaaggtttcatagaagaggaaacttattaaactgggtctaggaagatgtgaaggatctgagcaggcatggaagattttccagatggaaggactacatgtcagaatccatgggctccgtagacccaagtggctgggacttagggtgtacatggaaaagaggttggagataggactgaaaagggagccagcttaattagcttatttcttccaggatacacatgcaaacacattcaggaattttgtgagagatggggggtgaaaattaaataaaacaaacactcaaacacacacatgtgcgtgcacacacacacacacacgatcctggtcaaagttgccatattgcttgctcacaaatcagttttatcttcagaaaaacacagccaattttaacagagaatttttgtccttaagccatgttttaactttataacgtggagtttttaaaggaaatataaatagcacactttggagaactttcatgagtatcactctgaaaaacatacataagctttctaagattcttctagcaagcttcttcaaatctcccctactctcctccctccttagaatgtagttgctttgtaagtgggacctcatgtttacagataaggtctacatttttgggtatggcatgaatagtcctttatgatttggttccaacttatctttctagcctatcgcttactgtatttcccttcaatgctctactttaccatctaagtggaatatttaccttttattaattgaaaaataaattcatggaatgccttctatgtgccagaatatgtgtttgactctagggatatagttttgaacccagcagatgtggaacctgctttaaaggagctcatattctcatggcattgatagatatttacaagtaaatgcaataaattgtgatgagtattataaaagaacaaaaaattatagggatattacttacaatgggaatcagtgtacacattcctgaagaagtgatgtttgagctcctgaaaaataaagggagttatcagagggatggttgatggaagttggggagagatagagagagaacagcacacacaaaatgaagtatcctaggctaatgagaaagtgtggagccttcaaatcttcaaataattgtgacaaattcaatattatttgatataaaagtatgagagagaaatgagagctagaaggggccagttgcagaaggctttgtacactgtgtaatcaacataaacatgctgagggtaatgaaaaccaatgaagggttttaagcagggaacttacataaacaactttacattttgacactatcatacaggctgcaggatggaggatgacttgaaggggatgaaactagaggtgagagatcagctcttgcaattgctcaggtgaaatatgctgatgttttgtatgacagtggtggcagtagaaatggagagtagataatttcacataggaggattttggggagtagtgtggatacaggagacaaagaagtcagtgatgacaccaatatttcaggtttgggcaggtattatttattaagctggggaagcaatgagaaacactgtctctgaggggaagaagataacttcacatttggacacgtgcttgatggtctcttggaatacctaaataaagatgtagagtgggagtgagggatatatgttcagaactaagtggcgaactaagtggggaatttattaatctgggcatcatcaggatacggatgaaatcgaaagccatggaaatatatgtgattgttttgggggagtatgtagagtgagaaggttgaaaggctgaggactgagtcctggagaatatgaacattaggtcatgagcaaaaacaaacaaacaaagcctataaagtggcttgggaatgagctaccaatagcaagaggaaaattcggagagactgagtccttagaaaacaaaggaagagagtatttcaagaaggaaaagtatttctatgggtaaataggtttgagtagccttgagatccacatttgaaaagtgtctgttcttttgagggcttgatttgtcatgggtgatcttggtcaatgttaaaactctttctttctcctgcctttcagcccatgtttatattatattttcaattcctctgtagaattccatccacattttaagatttagttaaagttgaatctgctttataaaaatctttttgatcctccattcagagacacattctcacttttatgttcatctgtcattttatacaccttatatgatctttgtaacaggctacctttcctttcatcatttgggcatacatatcctaataatccagaaagttttttaggtacagaaactctgccttgaatgggaagataatagctcaaattatgaggatcgcacaactggtcacatagagttattatttatctttgcagaattttaagacacccaacctaataatgtagtccagggctctgggaaggcaggaattgtgtttcatttctgtaaattgttttatcctcattgcttagcccatgatatatatgaaactcctgttaaaaatgttcttgcatattttctttcacattttattttttctctgttgaaaaagtgatttcaattatgttcctattggacattttagtatttttgacaaattctaggttgtgtcatggcattattatttcattatcttcacaactttcattaaacatacttttttttttatcaaagtccccagtaagcaataatagagctgatgtggacatttgtatccattgaactagtctgcaagtggaatgacatcgttacacactggtattccctttttccagtaacactttgaatgagagccacttgagccatggtggtacttacgtgggttttgcttgtcacagtcccatcatggtttcagatgtcaccaacagctcctttaatgcctttattaatgtttgatcacttaggttctatcttactttcacttctttaatccatagtttgaaagcaagagcatttaaattaattattcccttctcaacatggagcttctctcaatgcggaaataagggtagacactgaggctggacacagtagctcacacttgtaatcctagcactttgggaggccaaggcaggtggatcaggtggatcatgaggtcaggagattaaaactatcctggccaatatggtgaaaccccgtctctactaaaaaaaaaatacaaaaattagctgggcgtggtggtgcttgcctgtagtcccagctactcgggaggctgaggcagaagaatcacttgaacccaggaagcagaggttgcagtgagtcgaaattgcaccactgcactccagcctggacagggcaagactccgtctcaaaaaaaaaaaaaaaaaaaaaagagtgggcgctgatgctctccctggcctccgttttaagttctgaaagcaattcaaagagaaagaggcaggtaggtcatcagctttctggaagaggttatactctatctcaaacatgcatccacttgctctttatgttcttataaggactcaggtacaaattagggaaaataaatgccagctgaggtttccttcctttgtaccccatccagggaaagagatctaacagtatcccaggaaagctttccataaacatcgtcctttttaattcagccagagttacatccagaaaaacaaccacttgaaaccctttgcccctattttcagattgctgccaaagcttttgccttagcttacttcaacaagaataaactgtacgaaagctctggagttctcagagaatgtgactgcctgccctgcttgtttaaggtcattaaaatcctggcctttgccaaaagacttagagcacagccattgtgttcttggagtgaactgtaattttgcttaggtcacagacattttagtggccaacaatattaagatgggtactttttaatggtgttaagtataaatgaaatgcaaagggtgagtacgataattacaaaattgtgtttatcgtgaagatagtctgtataagaaattgctaggacatttacattcattaattattgaaaatgaaacagccttcctattattctgtcagataaagaactctatattccaaatgccaatttcttagagattttattttctttattgggtcctaaaagctcttcatatttatcctgggtgcatttgcggccatgtacatatagccaaaaatatgtgatgagttgtataattatctggtgaatccaagcctagcaggacaacctgttaaagagataaaagcaaaactactttcaagtcatcattgcttggttattttgaactgaaatgtccagtagatcttccatttgctttggttaagaaaaaaaagaagctcatttttttcttcttatatgagttattttctctataatgaactacaaaaattgcattcatatatttgctttttgaatattacctgtattattaatgtgactgattagagaaaaatagaatagattgtggtccattttttttttagtattatgcttaagtacaaaagttgagaaaacatttcatggggttttttttggtaagcaaaagacaagctgatgtaatacatttgtgtttgaataattccgcatcaatatacatgaacctgtttatcctcatcccttccaaacagattgtaatagaaaaataagatacttgtaggttatatccaactatttaaagtatgcttttaagtcaaatgtacattaataatatttagagggtgaacacaggcatgttttgggtatgctcaatggtgggatatattgtctcagcccaggggaggaagatgggggccttgtgcagatgcctgggcccagaaggcattgagtgctgctggtgaggcagtacaggggcagaaaacgtagcagtggtggtggtgtgggtgactggtggtgtactatgtacttagaacctttcagatgttctattcatattatattatttaatcctcccatttatatgggaggttttattacctccattttaaatatgaaggctctgaaggtcattaaacttgctcaggattgcaaattggtaagttgctgttggaatttgcatgctattttttttctaattccacagttcaaatttgtcatgctagttttagatcacagtggttaatgtgcgcggtttccaaggattgggatacttcaagaagatgtcatttttaagttctgaagaactttaggaagattataggaagcttgctttatatgtgtaattaacctattgggacatatactaactcttgggcatttcatggaacaaattatttgttgagtactgagtgccaggaattgttgtagatgctaaagaagaaacagtgaaccaaacagctgcttcccaacaactctgataaggatagtctcagcagtactgacttaagaagttggtatatttgagattactgttaatgattttaaggttgcaacaaaatttaaaaacatatcagtgacattttatatatttgctaactgttgggaaattgcagttgaatacaagcagcagagtctttagaaggcagtaccaccaagaattagttattgtgtctttcaagcttatttgtgaatccagttcatttaactagatgactatcgacttattaaaaatgcataccctttgtgtgttccatagtgtgtctctgaaattgtacaggttaaacaacctgatgctcacatcaaatagcatggttcccatcatctacttgggtttcattgcgtgtccagcatgggtagcatttgttcctcaaattctaattgtgcttttcatttccagctaccagcactggatagttttatcagacaggtagaaatagttttgaatacacctagccagattcccatgcatggcaggtcacattcaccttccttctgcacttccattccctccaacaattggcaaaattacattcgtatgagttaccttacacattttcagatagacacatatgtctgctgtctctctgggagcattctaaattttgtcagagcagtgcttgggcaaaaagaatccacaggtaggaatatccaataatctgctcactcccaacctggttgccttcaaaaggcgaattattcttgtgcattcagtaatggtttttactaccagctctgccctgaacaactgattcagaattccgtaatttctttcttaagcatggtagtaaatgtggtttcttggacttcttcacatgtacttagcaatttgaacctcagtagaattaaaaaaaaaattctttaaagaccagaaatttgaaagaattaacaattccaggaggcagagtaaaaaaaggattggtaagggaaaagatgaatttgtttttgctggtgtttccagaagtccggaggtatattttcgttctcgtggttttacctttcagccctttctctaagtctgtcagctaacaaaatgcctgcagtcccaaaatgttttattctctagtaaagaaagaagtatcaaattattctaagcatcactgtttatttactataatcccagtaaatctaagttgagataatgagataatgccatctagaagaaaaattaaaaaatattagaagcattttttttaaactttagagataagtagcaaagtttcccttgtacggacagctctcttaaattcctacccttccctaatgctaataagcaatatataatacagttgagcaaacagacattcaccactctttttatcatttaaatggcctcttttagttaacaacaagaaaaaataacagaaaagcccttttaaattctttctataaggaaaacactttcattagaacagacttttatcacagaactagatcattctggggattgcttggtggtaagcttctttcttacttttgtatcctcagtgcttaacatcccctgagatgtaattctcctttgttgttttcctgcataaatatttcttatgattacatattgcccagtcagtgaagtccgaactcactagtatgagatgtaaaaggccatgagctggcactttattcctcctcagtgtcttttctctctactttcccctccatatgtcacattgtgcatttttaggaagaacaaaatatagtcatgagccacataatgacgtttcagtcaataatgtcaataacatacgcgacagtggtcctgtaagattataataccgtatttttgctgtactttttcaatatttagacatgtttggatacacagatacttaccactgtgttacaattgcctacagtattagtatagtaacatgctgtacaggtttgtggcctgagagcaataggctacaccatctagcctcagtgtgtagcaggttacaccatctaggtttgtggaagtacactctatgatgttcgcacaatgacaaaatcacctatcaatgcatttctcagaaaatatccgtttcgttaagtggtgcatgattgtagtgagtttttttttccttttgtgaaacataggtgccctgtagaaaaaccacttgtcaccgggcacagtggctcacgcctacaatcctagcactttggggggctgaggcaggtgaattacttgagctcaggagttcaagaccagcctgggaaacatggcaaaaccctgtctctacaataaataaataaattagccgggcatggtggtgcatgcctgtggtcccagctacttgggtggctgaggttggagtatcatttgagcccaggaggttgaggctgcagtgagctataatcatgccactccactctagcctgggcaagagaacaagaccctggctcaaaaataaaataaaataaaataaaaaataaaaaacaaaagcaaactaacaaaccaaaagaaaccaaccacttgtcttggagccctgtcccttcattttagatgctttatttatagaagtaacaagttggaattgattctcctgaagagttatttatgagaagttttttttccagtagcatctagacttgcattttcagcacatttttatattgtttagctaagtaagaagaaatgtactatggggtggaaaatttagatggattaccactcaagatatcaaagtatagtcataaacttagtttcaaagttggggaaaaaggtgaccttggtaaataaaaaagtgaattccagtcaaggaagcaccatcgagttcatagaagattaaatcttttctttcttttttttttttttgagacggagttttgctcttgttgcctaggctggagtgcaatggcacgatcttggctcaccacaacctccgcctcccaggttcaagcaattctcctgcctcagcctcatgagtagctgggactacaggcatgtgccaccacacccagctaattttgtatttttagtagagatggggtttctctatgttggtcaggctggtcacgaactcccaacctcaggtgatctgcctgctttggcctcccaaagtactgggattaccggcgcgagccactgcgcccggcctagaagattaaatctgagatctgattactaatgagatctgatctcacctggaacatagtgactgctaatgcttatgaattgacttgaaacttaaagcccaaacgggtttactggtagcagaattatctagaaagagcaaagccatggagctattccattaatcagacccatgtctactgcttgatgtcagggcaacatgtatctctcaaatttatctgttaccaaactgtgccatctaatggtcagcttcctctatctgatttgcctgagaaaatcgtccttttaatcttgaatgatttttacaacctaagcctatgttttttgtggagtaggtcctggtttttactacctcctgatatttttttcatcaatgacccctattaggaaactatgtatttatttgtttatagtcaacaaatatttaatgagcacctacttatttgcaaagctttgtgctaatcactggggatacaaaagctattaagagtggcagggtctttgcccctctgcaactgagtctagtgggaatacaaacaggtaagtagtgcctaaaatacagtgtgattaataccatgataagggaagtacagaatgtctcttctccattcacagaagagggcacctcacccaggaatggggatccagggaagacttcctagaggaagtaagagactttcattcaagtctttataagagttctctggctgcagtgtgaagagtggcttggtgaagaaatgatggccacctaaatatgaaagtagagaaaacaggaaagttttaagacacaggagttataatccatactggtgtttgatttgatgtaagcagtgaaggagaaggtattcttgggaatgatgctcagctttatggtttgggaaactgactggatagtagtgacattgacagagagagcaaatgcagggtgtgacagtgaggagatgatgagttcagtttaggacatggtaattcaagttagctgtgggagaaacaaaaagatatgttttatagactggtgggcattcacatataacactggatatttaaaaattactatgagccccaggcaaagtggctaatgcctgtaatcccaatacttaggggagtcaaagcagatggatagatcacttgagcctaggagttcgatatcagacctggcaaccctgtaagaccctttctatatgaaaattaaaaaaattatctgggtgtgctggtacattcctgaatccccagctccccaggaggctgaggtgggagaattgcttgagcctgggaggtacaggctgtagtgagctttggtcaagccactgaacttcagtctgggtaacagagtgaaaccctgtctcaaataaataaataaataaataaatattatcaataaatagatcataatcaaatcatataaatcaatagtggtggacctcagaattctaccagctatttgggccagtacccaggtgtcttatcagtctgtgtgcaggaggcacaaaagttcacctaaccttattcacaaattttcaccttaaatggagtttgaaggaacctgttagtcttaggcctttctgcatatatgcatatatatgcaatatatggcctttctgtctcttacatatacacacatggtatttcagcaaagaggtgatatggcattacagagaggttgcaggacaagaggacagaaacacccaggttttaggcaaaagctatgttgctttccaatatttgactctggttcagtctccagttgctttaactgtgaaatggagatgacgaaatggctcttcttacaaggtggtttgaggctcaaataagtgatgtattacaaactataatatgttacacaaatgcaaagcattgcaattagctccttcttggcaataaacaaataaaaaatggaaaaaccaagctgtaagtttctggaaaacatttctctcttataagttttttcattcagatttattgaaaaaatgttttaagcatttagtcctaagaacacattgtttagaactgaaaaactgaaattggaaatcatatagccttttagaattctaagttagcaacctgaagcatttggactattatttgtttcttatttgttgcgggaagtcagggacccagaatggagggaccggctgaagctgtggcagaagaacatgaattgtgaagatttcatggacatttatcagttcccaaaattaatacttttataattccttatgcctgtctttactgcaatctctgaacataaattgtgaatatttcagggacatttatcacttccccaatcaatattcttataatttcttatgcttgtctttactttaatctcttaatcctgttatctttgcaagctgagaatgtatgtcacctcaagaccactattgtacaaattgattgtaaaatatgtgtgtttgaacaatatgaaatcagtgcaccctaaaaaagaacagaataacaatgattttcagggaataaggaaagataaccataatgtctgactgccttcaggtttgggcagaatagagccatatttttcttctcccagaaagctatagacagatatgtgagtaggagaaatatcactgaattcttttcccagcaaggaatattaataattgataccctgggtaaggaatgcattcctggggggaggtctatgaatggctgctctgggagtgtctgtcttctgtggttgagataaggactgaaatatgccctggtctcctgcagtaccctcagcttactagggttgggaaattccagcctggtgaattctagtcagaatggttgtctgctctcgaactctgtttcctgttaagatgtttatcatgacaatgtgtgcacagcaggacatggaccctcatcagtaattctaattttgcctttgtcttgtgatcttttattgccccttgaagcatgtgatctttgtgacttactccctgttcgtacacccactccccagcaaaaacttgctggttttgcagctcaaggtcgccatcacggtcctaccaatatgtgatgacacccccggaggcccagctgtaaaatttctctctttgtactctttctctttatatctcagactggccgacacttagggaaaatagaaagaacctacattgaaatattgggggctggttcccccgatacgtattattttcttatatttcattgggtaagtgaactaaggaatactgcaaggaagacaatacttttgaatcgtctctatgtgcctgatagatcatatctaagtgtttaaaaaagataatataaggaaaacaatcactgtgtcaacatgaagatttgattatgcctttctttctatgacctgttttcatgaacattcaattttccttggcctcttaggaaagaaaggacacacactggcacactatagtggggacatctggatctctgaaattgtctagcaaagagaggtcactgagcacccatatgaataggagacagaagtcagagacagaggcaaaaaaaaaaattagaataggagacacagggtagtaaactgatgtttgtggcttagctcgatttttggtaatttaaaagataatgttgataatatgattgatacggacttttaagaaagagaagaaataaataaataaatctcatgagagacacagatgcaggtgtcttgaaccactttatagagttgtgagtatgtggtctgaaatattttatgaaaatgacgccttggatacatttttttcttgtcagttccttcggttttgcatttttgtgtgtgtgatttagtgctattaaaatagtttaaaaaataatgctcagagttgatcatgcaatttaaaaattaaatagaatagagaggaagacagttctaaaaaggaaatctgaggggtatgagataaaaacgtgttgatcatggtctttcaaacatgaatgtgaatatgaatatatttacatatatacctacatatatatatatgcacatataaaagtttattgttcttaggcactctgattatatcacaaatactttaattttatgcatttggttttcaaaatatcttttacaattcatttttaaatattttgtgtttacaaaatgcctatgtgtaaaaaatctacacttttacctatttagtgtcactgtgaattactcactatatgtttctcatgggtagtttgaagagtttagagaagtgcatgtttgaacatcatggaaaagtaatatttaagttcaggtggttgttgggttctggcaatatttatgtaatattttatattttttttcaaagaactctacatctatataaatgtccagatagtcaccaacatttggctctaaccttcattatgcttgcttttattattcctataaagtgtccttctactgagtgtgtatatttgaaatatgatttgaaatttttagtatgatttaatgctaaaccttgcaattaatttcatttatgattttaaagcatttcttcagttaaatctgtggttttatatttattagtgaaatttcctcccagatttgttaagatataacttacacacaataatataagcatacagtctgatgaacttttgcaattgtatgcaactgtataactaccaccacaatcaggatatgtaaaggcagacaatttcatcacccctttcagtctgtctcctcctcaatgttgtttgccttttctggaatttcgtataaataaaattatacagtatgtagtcttttgtgtttgacttttttcacttaacgtaaggttttttgaggttcactcatgttgtgtgtatcaatagtttgttcatttcatttttatagggagatagtattccaatagtatagatataccacaatcattttatccattcattagttgatgtaaatttaatgtttttattttcagtgtttagctatcttgaataatgctgctatggccattctcatatgaatgtttttgtggacatattttttcatgtctctggggtgaaaacttaggaatggaatttctgtgtggtgcgatagatgagtatggtgtggtaggcacaccaccaacctgtcctccaagtggctggatgattttacactccaccagaaatgcatgaaagttccagtagttccatgccctcatcaatagtacctgttggtgaattttggtcattccagtgggtttttagtgaagttttaagtcacaggttaacatgtgactgaaaatatttctctactaaaagacaaaatgaaggtgcattttatttcaggctctcagtctggtcagccaccagcatggactcggaatgcataagccctggttttattgaactgaaatatttttcttttcataaagtgaaatattaaagtgtgttggtttcagtttgataattcaaatactgccattttaatggcttccatcataaatctattttattgcactctgtgtcatctctcatatcttggataaaaatgcttttgtttcctttctggttaatagacttggaaatcatctgtgtatacgtttgtttctttcctttttgtgattggagtgagttagtaataaattcttttttttttctcatttttttttccttagcatgctttcaattctgtgttacataaggccaccatagccgttgggaactggttgtttttaatgatgattattttaatgatgtctgttatattgtaagttgtcaaattattgacaatttttgaatattgtcaaaaacctctattctctttaagaatatttatttctctttggagttccactatattgcaaggtgaatgaatgtgtttgacaggtaatggttagaagtctgtatgaaattcttctgtgagtaaaagtagctattatcactgagtatgaatatatgattttggagtgtttttgtttgtaataaaatagtataacatttataacatattttcttgctttttattaaagaatcttaaaactatggaaaatgcagttctacaaggagtctacaatttagtggagaagacaaaaaacaaaaaacaaaaatttagtaattcaagttggtgtatggtatggagaaattatttctccccagtcctgatttttttcttccatgtgaaaggagcttagtattcttggccagagaacttcctttttatcctctgcaagaacacagagtaaactactttgctggtaggcatttgttagtggcccacatttcttaattagttgaagtgaaaatacacagggtctgagtctggtcactctgctctttctgaaccagcgagaagcacagaccttggtatgtgaaatcaaagtgtggactcaaactttcttttaggtggctatttcagggtttaataagagggaagaaaggtagcaagcctatctaggcttttgtactgaactgtgtcttctctctggcattcactggcaatgatggtgatattttggtttcaattgctgactgtctcgccttatttctcagtcgacttagaacccatttgaggaacaggctggtatttactggaacccctgaaaggctccagcaagagttatatcaacataggctatagcctcagtgtcatctctgattagttgctaaaatatttcacattacagactgtctcctgcactggattgtcagtatttaaggctgtcttactcaaagtatttgatagtcctgcctgtgggagcacactgccttttgcactgttaggtttgaatgtggccatatgacttactctggccagtgaaatataagtggacgtgacacataatatttctggttggagccagtgatactctctttttctcacttctgcagtgatgaaaacacatttttaaaagggagcctgtatcagtctaggctctggagtgaagaccatgtggaccaaatccctttgcaaattggcattgaacatgtggcacatatgagaactaatttattacctcaaattattgagattttggggttgtttttagcatagtgtatatcttattctgactcagacagagttacttattccttgaaaaatgatttaatggttaaatatatcatgacctttgatataaatgtgatatctcacaattttaaaaatagggttctctggggtgggtggagacgggaaggtattctgcattaaatgtgcttatcacataacacatatctatttctgaaaagtcaaataggctattcatacttgtgcatatcagattcctatcaaattacccagtagagatcagaattttatgtgaactggccaccaacaagtatgctttgatgatggagtgagcagaagaaactaaagctgggaggaagtgggtagctgactgcagcagaactgttagcagaatttaaattgggctcctgagtgattggctgcttcaaaacaataagggaactgcatacaatttagttagcatgccataacaaattccacttgattagtagaattcacaattcatagtgatatttatccttaccttattctgtctctttagctatacctaaacttttttttcccccttttccctattttcttctgcttcttttcacaaacacaaatgctggccacattagaattagcaagacatttgtccaaagacagaaagtttcaccaatattttataagtggcaaagttttccagttttcttttaattctatcctcttatcatcaccatgtcaaaccataatgcaaagtgggcagaaattgagctttctgatgtttattttgccaagagatttgcctcattatttggtgttacaggatttattacttcaccagctagtttaatagtttcaaaatgaatctgtagatgtgctcattgaagagatgctactttttatcagacatacataattttttttaagctttctgttttcattttcataatattctaatccctggccatgagatttcagtgggggtgtttgagtttatccatttattagtgtcatgctaatcaaagattaaatgacatgccctgcaatgtaaataaaagttctaactgtgcttctgttgaaaggtaaactgatgtaagaattgagtgttttatagcacatagtggtacagccaggttgaactcagagtagctgtgttcaaaccaatgggaccacacctgaaggacagatcattacatgaaatacatatgaaattggtctcagtctgaaacaaattgcaacatttcaatagaagtaaatacaatggcaagtataaaataaagtatttttttgattccccattcaagcagtaattaaattacatgtacccataatgtacattcccataatgttacagtatgaatatatactttgaatgcttcaaataagcatgacagatatagaattatgaagaaattgttgatttaaatagatttttcaagatggttttctcagcaggttaggagttatatttgagctctgcttatcactaactactaaaaaaagccaaatatttaataatatagtcttacatatgcaaatagaggcacctcaggaccagtttttgtaaattgtagacacccctacctccactaggaaaggctatgggtggagagagcatttctactgagagaatcgtatttggggtctacagaagagcagtagagatatgcttttttcttcattttcagttagaggagtttcaaggaaaaggtttggagaacttgacatgtgcccctcagttttgaggtctcagtgggctggcattctgttcttcttctcatgaggaatctacaaaggagactatgactgactggctgcttagattatggagggaaggaggcagggtgtactgtttgcactcagacaaaagatacatgggtgtttccattgatcagatggggactgatatgatttggctgtatccccacccaaatctcaccttgaattatatctcccggaactcccccgtgttgtgggagggacctaggatgaggtaattggatcatgggggtgcatctttcccatgctattctcatggtagtgaataagtcttatgagatttgatgggcttatcaagggtttctgcttttgcttcttgctcattttctcttgccgctgttatgtaaggagtacattttgcgtcctgccatgattctgagacctccccagccatgtggaagtgtaagtccaattaaaccatttttcttcccagtcttgagtatgtctttattagcagtgtgaaaatgggctaatatagtaaattggtatcaggagtagggtgttcctgagaagatacccgaaaatgtggaagcgactttggaactgggtaacgggcagaggttgaacagtttggagggctcagaagaagacaggaaaatgtgggaaagtttggaacttcctagagacttgttgaatggctttgaccaaaagcctgatagtaatatggaaaataaggcccaggctgagaaggtctcagatggagatgaggaacttgttggcaactggagcaaaggtggctcttgttatgttttagcaaagagactggtggcattttgcccccaccctagagatttgtggaactttgagcttgagagagatgatttagggtatctggtgaaagaaatctctaagcagtagagcattcaagaggtgactttggtgctgttaaaagcattccattttaaaagaaaaacagagcataggagtttggaaaatttgcagcctgatgatgcaatagaaaagaaaaacccattttttgaggagaaaatcaagctggctgcagcaatttgcataactaacaaggagccgaatgttaatccacaagacaatgggaaaaatgtctccagggcatgtcataggtcttcatggcagtccctcccatcatggacccagaagcctaggaggtaaaaatggttttggggacctggcccagggtccccatgctgtgtgcagcctagggacttagtgccctgtgtcccacctgctccagccattgctaaaaggggccaaggtacagctcggccatggtttcagaggatccaagccctaaaccttggcagcttccacatggtgttgagactgtgcatgtgctgaagaattgaggtttcataatctccacctagatttcagaagatgtatggaaatgcttggatgcccaggcaaaagtttgctgcaggggtggggcccttatggagaccctctgctagggcagtgcagaaggaaaatgtggggttggatcccccccaaacacacatagcatccatactagggcatcatctagtgaagctgtgagaagagggccaccatccttcagaccccagaatggtagatccactgacagcttgcaccgtgcacctggaaaagccacagacactcaacatcagactatgaaagcagccaggagggggcctataccctgcaaagcaacaggggcagagctgcctaagattataggaaccttcctcttgcatcagcatgacctggatgtaagacatggggtcaaaggagatcattttggaccttaaaatttgactaccccactggattttgaacttgcgtgggccctgtaacccctttgttttggccaatctctcccatttggaatggctgtatttacctgatacctgtatcttcattgtatctaggaagtaactagcttgcttttgattttacaggctcataggcagaagcgacctgccttgtctcagatgagactttggactgtggacttttgggttaatgctgaaatgagttaagactttgggggactgttgggaaggcatgattggttttgaaatgtgagggcatgagatttggaggggccaggggtgtaattacatagtttggctgtgtccccacccaaatctctacttgaattgtagctcccagaattcccctgtgttgtgggagggacacagtatgaggtaattgaatcatgggggccagtctttcctgtactattcttgtgatagtgaataagtctcacgagatctgatgggtttatcatgggtttcctctagcttcttgctcattttcttttgctgctgccatgtaagaagtacctttcacctcctgccatgattctgaggcctccccagacatgtggaactgtaagtccaattaaaccattttttcttcccagtcttgggtatgtctttatcagcagtgtgaaaatggactaacacagggccatgtgatagagttggaccaggagattgtctttgaacctgctcaggagggtatcctggagaggcaaggtgactgtaccagagaggactgcccacttctgagctgagggagaatatataagcaaatggtggaaagatacatttacccaagtcaaggaaactatttgtagcttttcagggacaaaagaaggaatgtttagggacagtcaagaagggagtcagtactaaacacctgataatcctagagaaaagtagtgccagctgaagatagaaacaataaagtaacattttccttccttcatacctagaggcatagaacagaataagtagaggaggaggacatgagtgccttggtgctcatctatagggtactgcaaagatgcaagtctgcaaactcgtacaaacactgcagcatacagggagagtactcattacccaggcagtggttaccctttctatgctgctgccttcttctcatcttcttttcccctagccacagctggaagtggtgggcaggaaggagctatcagaataaagataacagaatccaagcaccctctttccacagttgccagcttcccactgcagcagcaccagtctggggagtgaggatggggaggagaagaaagtcatctgtaaatgaagtttagagttttgtttattacaataaaccacttcatcattcccctataacttttcagtgactcctcattcctcacacagtaaaagccagcattcttttttatgacctgcaaggctgctactcaaagagtgggccatggactggcagcatcagcactgcccaggagtctattagaaatgccaaatctccagacccatcctagacccactgttttaatccgttttcacactgctgacaaagacaaacctgagactgggcaatttacaaaccaaagaggtttgatggacttacaactccacatggctggggaggcctcacaatcattgcggaaggtgaaaggcatgtctcacatggcagcagacaagagaggagatcttgcccagggaaacttccctttataaaaccatcagatcttgtgagacttttcactatcatgagaacagcaagagaaagacttgcccccatgattcaattacttcccaccgggactctcccacaacatgtaggaattgtgggagttacaattcaaagtgagatttgggtggggatacagccaaaccatatcacccactgaatcagaatctgcattttcacaagatccctaggtgattcacatgttcactaaaatttgagaaactccatgacctatgaacttctacccctggttctctttttggctcacatagtaattttctcagttttcctactccaatcatgttatttcctgaacatactaggtggattcttgcctgagggccttagctctgactattccttctcttttgaacaccatttttcaaatacctatatactcactccctttcatctttgtctttaatcttctcagtgagaccaatacacaattaagcttgcatttagaatttcatctccatctgccagcattcccttcctctgccctgacttttttcattcacatatagcaccttttaatgtactgtagaacttgctttttattatgtttattgtctgtctttcctgagaatgtatgctccaccaaagcagggattgttgtcttgtctgctttgcctgctgatgtttctttctctcgctctctttttttttttttctttttgagatgcagtctctgtctgtcgcccaggctggagtgcaatggcgtgatcttggctcactgcaacctccacctcccagcttcaagcaattctcctgcctcagcctccagagtagctgggatgtgcccaccaccacacccggctaatttttgtatttttagtagaaatgaggtttcaccatgttggctaggctggtctcgaactcctgacctcaagtgatctgcccacgtcagcttcccaagtgttgggattacaagtgtgaaccactgtgcctggccctgttgatgttccttgagtttgcagaataatgcctgacacacagtaggtgctcaataactatatcttgattttttttcaaattatcaatttctctaagcacttaatgtgattaaaggcaaacagaatctctgtaaagcatcttattttattggcatacatgtttgcaccaagaaggccactggacaaagtaggcaagttgttttaactggagaatatgggcttttactcatcttcacaattttgatgaaggaagctttatttaaaacaatttaataaattctttcatacttacccaaatgagcttctctcctgagagactgagaaaacacaaagagatttatctaacaaaattttatcaggactagtgtctgaaagttatgcgcactgttttctttttccccaaagaaactaacctgaacttttttatgtttctatccaaatttgaatgttttgttgtacaagctcacttgttcttggacaatgaacctgtttctaagaaaggctaaatatgctcataaagaagactcaacgggcttcttggacaacaaataatttttacaaaacagcactttgatgagtaaagtgtaagtaaatcagaaacagatggaatacatagttactgagactcacaagtttgaaaaacaagtgaaaatttctcatgttttgtgtcctcaaatataaaaataaagtgtatagttgaaacaaaacttttctaatttctaccatgttttgactttaagatcgtgtttcctacatgcttattttttattttagagatggagtctcatttttttgctgaagctggagggcaataatataatcgcagctcactgtagccttgaactcctgggctcaagtgattctctcacctcagcctgccaagcagctaggaatacaggcacataccactgcacctggctaacttttagaaagaatgtctcgtagatatgggatctcactatgttgcccaggctggtctcaaactcctggcttcaagtgatgctgccattttggcctcctaaagtggtgggactacaggtgtgagtgtccatgctggccaaccatgtgcttttctgataggaagtattttctatttatgaacttcctctttatagcacttacaggtaattgaattgttctaatttctcaattttgaaccaagctaaatatattattaatgtacttaggacagtctaaagttattcatattttcttctattttaatatgaggaatggcacaatttttgttttttgttttgtttcagttagtgttcttttggtcataagaaacagagatatgcatagattagtttaagaaatgattattctgcaaatatacaaggacatgaagaaatccatgcacctgagtatggttctaacatgagcatctgcacaacagagcatcatggcaaatggaattgggaagccactagaaatggctaatggctgatctttttcatgaagttttgctcatggctcttctcggctcacctgaaccatttttcctcactttgctgattactgaccttataaattcagcttcaaatgacctacagtggacctggactgagcttactttattatttattaactcagctgccctagcagtctgacttagactcttcagtttcaaattcctgaaagaagactctggcccagctcattttttgaactaggtcactgaccactcaaacctatgactagactatctggtgcaatcatctgtggttgaggcagccaggtttctgcgcaagagagaggtgtgtaaacaggtggaaattcgggtggttcaggcttcagtgtgctaaacacatactccaggattcaccagttgaaagaaaattaccagtaaaatatttttgccaggatattccttggaaaataaaatattacttgtttctcttttcaagaattgaaatgctttagattttaaatttaggatgccaagattggaaagggtgtagaggactttcaaagttcaaaattttgtctaatctgtctggattttgagaaaacaacaacatcatcaattacatgagcgttcaagggatgtgcctttggagatagtttattgtattatttcaaatatagtcactctctttatcttcctaagagccctgaaatattccataaaaaagtaatcttgctttcatacacgctgatcttataaaaggctttatgtttaaaaaaaataacagacttggggaaattggaggagatccgatgaaaacctgataacagttggaataaactttatttttcctggagaaggcagaggagataataaataataattttaaataatatataattctgatgtaggatttagacaaaaatctgctctgtcagcaactggagtttagaaaaccctcaaaagggagataataactacaactgaaagaacagcaagtgaaacaggacctgacttccagccttggctttgccagttaccagctgggctaccttggttacctggtgacatgaaaaaacttggactggatgccagcttaggtccttttttttttttttttttcgagacagagtctcactctgttgcccaggctggtgtgcttatggtgcggtcttgactcactgcaacctccacctcccaggttcaagcgattctcctgcctcagcctcccgagtagctgggattagaggcacatgctaccagactcagctaatttttgtatttttagtagagatggggtttcaatatgttggccaggctggtcttgaactcctgacctcctgatccgcccacctcagtctcccacagtgctgggattacaggcgtgagtcactgtgcctggcctggtccttcttaacattaaagataaatctaaaaaagagacttccagggccactgggcatggctgtacaagaggttcattgcacatttctaaggtgtgacattctgaggattcttatttttatgtggaattttataaagagtaatgatttcttccacatgttgtattatgtttggctcagaatttaaagctcaatcacccatgcaatggcattcatctgaaccaagaaaaagcaaggggaaatcggatgcaggtgacaaggtttgagcttgtgactgagaaacagagctaggtatatttttatgtccccttgaaagaaaaatagactcaaagcatccctatgttgtatgggaactactatcattcaaaaagagatacaaatcactatgtctgattcgttgctaattattgaaaaacgatatatctagacttgagactaattgtaagaaaaaaatcggcaaacattaccagtgacaaaaatataggtttatctatcatagcactaaatggatataactctaaaatacacaggttaaaaattttaccctacctttaggcatagttattccaattcattcaaagaaaaacaggccactttctcacagcaaatcgagcattatgagagtatcacggttttgaaacaagagttccctgaaagcagggctcttagaatctagattataatatcaaaggctttttcaatggtcagaagttgacttgaatagacattttctctcccacaataatgtcaaccacaggcatcgcttcacttttgtaaatgtattcattgaatatttgcctatttatatattccaaggacattgtaaaatttcagcctctagaagaagagtggatccagccttccgcataagaagtaggattctaatgagaacacatggacacagggaggcgaacatcacatactggggcctgctgaggggtggggggcaaggggagggagagcattaggtcaaatacctagtgcatgcggggcttaaaacccagatgacaggttgacatggcacatgtatacatatgtaacaaacctgcacattctgcatatgtatcccagaacttaaaataaaagaaaaaaaagaagttgcgttctgtaaggtataatttgagggcctaagaagccagactattttccatgtccaaggataattgctatttaagttaagaatttttctgtttccacttatagggtggaaaacaccttaatatcttgtaagaatgagcttattatagcggttttctttaatgataggaggggcttatgtgggcacttttggttcctaagcagttggtgtaaaaatgagaaggcactgaaaatacatttttctcctagaaatgactcatttgtgtgtgtgtgtgtgtgtgtgtgtgtgtgtgtgtggtataattttatgattttatatattatacagtattttaaaaaacagatactttttaaagatgcatgatagtatcatacttttattatgctaatccccaatgtgataaccaagatgatataataacacaaaattgcatcttattttaatcttgaattaataaataaactataaaataagataatctatgtttgttgaccataaaatcccgaagtccattagcattacttattcataaagagtattggtaatatgaagtaccaatatgatgaatacattctttgaaaaagtgaaagtgaacagaagatgtaaattacactgactttttttgcccaggggaaaaaaagagcatcatgccacagctggagtaatgacaaagtttattgggttacactggataataattctctgactttgattctttgatatacatgccagggagattaaaaggaggcctgtgacttgtttaagaacaccgtgttttgaattgtttgctgtagtttttacctatcccaaatttgtaagtctatggatattaaaactaaaatagaattcatggttgctcttagggaatattggctgagccaggttgcaagtatggatcagcttgagatagttagctttgcaaaggagagaaaagataagtcacttgcagtctgttttccctgtctttcaaaactatttgttcaaaactaaatcccaaactgctcctttgtaaacacagccaatggggcttcctaactctcatgaagtaaatagtttcagctttacaaaattgcagaatctcaggaggctaagaataatctagtgaacttgatcttatctaatgtattcagtgttctttgaaaatttggggaagcatatagaaaatgtaagtagcatttacctctgagtgttaatcttggaaactgagtgttcactagtttggatgcactcactgcacttacttctcttagagccagggctcaagtaatagtgattaaacctcagggatctctttaacactcaagaaaaaattatttccttttccatattccaccgtgaaaattggctaactttattggtgatgagaaagaaacgatcctccagtggagctggaggccattattctaagtgaagtaattcaggaatggaaaaccaaatactgtatgttctcacttgtaagtgggagttaagctatgagtaggcaaaggcatgcagagtggaataatggactttggagactcagaagggagagagtgggaaggcggtgtgtgataaaaaaaaaaactatgtattgcgtacgatgcaaactactcagatgacaagtgcactaaaatctcagaattcaccactattgtccatgtaaccaaaaactgcatgtaccccaaaagggattgaaatttaaaaaaaagaaaaaaaaagattctccagaacaagggctttagtgacagcctaaggcaaatcatttgaggatttagtaatagattttctcagcatggaaaggctctgattccaaaaactgactcaaatatataaaataaaatgatattcaggaaccttatttatcttacttgaatctttcttgttccttcagcttgtcttttccatcctacaccttatcaacttttctttttcttttccttttttatttttattttttgaggcagaattttgctcttgttgcccaggctggagtgcaacagcacaatctcggctcactgcaacctccgcccccagggttcaagcgattctcctgcctcagcctcctgagtagctgggattacaggtgcccgccactatgcccagctaatattttatatttttagtagagatgggatttcaccatgttggccagccggtctcgaactcctgacctcaggtgattcgcccacctcagcctctcaaagtgctgggattacaggcgtgagccactgcaccaggcctcaacttttcttttgttctttgcttccactccaacaacttcctggactttgcatctgtaattgatttcaatccaccacaagtctttgctgaagatctctggtagatatcctgttaccagcatcatagtgaaccttctaagtatctcctggttttctcaagaaatcaaattcacttttaccctttttattctcagtgtatttcctggccttctttgaattgcttctcttctgttacaactttctttttctgacactcaggattcttctctgctttcctcgtttattcttcctactgtgcttgctttcaatctctacacttaccatcttctccagaacaccgccatatttttaatctctgccttttttgatttcgaatttgccaatatgctactctcccacatctttacacatgaaatggcattcttgcaaaagtaacaacagcaaacagcaacaatatgatatgatgtgatatgaactcgcatcgatatgcttggccctcaagtcaatgacacacagttttctttgtgatcaacagataaacttacggggagaataaccttgctggctccatgtattcacctccaggtactctttagccctttgcaaatcataactcttttctcacatctctattgaagctctttttccgaaggtcaccaatgacctccccaaaatgctgcttctatctcctgcaatatacagaacttctagccattgcttccctccttgctatttacttgcttgaaggctttgctgtcattaatcactctctcatcatcatttcctccacatctctttaggatcattttatatttacctctccattttattttgaccacatttatgatttttttcttctcacttctattataatacttcaggccatattgcctgtgtatacagctgatacggtttggctgtgtccccactcaaatctcattttgaattgtagctcccataattctcatgtgtccttggaggtaattgaatcatgggagagggtctttcccttgctgttcttgtgatagtgaatacgtctcacaaaatctgatggttttaaaatgggagttcccctgcacatgctctcttgcctgctgccatgtaagacatgcctttgcttctcctttgccttccaccatgagtgtgaggcctccccagccatgtggaactgtgagatcattaagcctctttcctttatcaattacccaatcttgggtatgcttttgtcggcagtgtgagaacagaccaatacaacagcttagttactttcacagtaacttctaaattcatacaactgtccctgcctcctccaccatcatcctagtccaagccaccagcatttctcatgggactcctgatttagcctcctgaccagtatccctggttacctctttttttttctcttataatccgttccccacaaagcgtccagagacatattttaaaagagataaaatcacataattcttttacttaaaacctgccaatgtctttttacagcacttaaaaataaaagcccttttcctaacttcaaagcccacccatctaaagtaaccaccatcacttggtatcacatctctgttttcaggagagcatttatcctaatttgattgattgttttctgatttatatttttcactattgcctttgtttatttgtagtctgtgtcttcttgctaggacatattgtctctgagatcagcccctcatccccttcttaaattgctgtgtcacaggacctggaaaagtgcctagcacatgatgacctcaatgtatattggctgaatgaatgtcttgtagacctttggagaatgcatctttaagtaaatgcccagcattctgtctggctcaaagttatatttatttaaaaattccaaaagatggtgtcgaattaccatccatgaaaactgctaaagatttactctcccaccaacagtgtaagaaagtgcctcttaatccatattcttggtcacagtaggtataatgaaactataaaacctttgtattgcctctcatggtcctgcgtgtctgctgggctctgcagaccagttctgctagtcctacttgggatttctcatgaggctgtaatcagttggagtttggcatcctctggaggacctccacctgcatgctgagacagctgggcatctctttttgggctccagttcatcctagcgcctttcctcttcatgtgatctctccagcagggtagctggactgctcacgtgactgctgaggagccgcaaaagctcatgcaagagggataaatcaccaggtgttcttaatatctgctcctagaattcctgaagtgctgctaggtttgttgtctcctggtcaaaggggacaggagctcagtccagaggccagagaggaggggtatgaatgtggagaaaagggtgggcttatctgaggccatctttggagcctggctgtcactataggtacaagtgagggagcagggctgtggcagtaagggcaagaattcccaattctgtggtagagcatcctcatgaattagaaggtcaggaaaggaactcatatgacaaaagataatgagacaaattagcataaaaacacatctcttgaaatttagctggtcctaaaatctagaagttctctttattatttaaagggaatgtaaatgaatatggcattatttttacatttattttaataatctaaattctatcacttttttagagttttattttacctatgcctattaaatttcatttttaaagtatcttttgcctcacacatgctactgcagaaacccacaagcatggatggaatcctccttgtggtctgtttctgacattggtttttctcaagtactccttttaaaacttgtggaataatactgaaacccccaacagacaatctgctctcctgtgtttattactgagtaccaaagccacagctttaaccaccgcagcactccattaattgtgggcatgggatgctcaggagaaccaccccttgtgattgtggcctgaaaccctccaggaggcctataattgactatctgacctccaaaacgggagtgactgtattaagggttccacataaagctgggtttggtttattttgtgattggtatgacacattatctgagcaggaagtccagatgttgtcaggcatgtaggcccataaatctggagaatgataaaaatgagattgtaggcatgcaaagagagatgactggaatggaaaaaaaaaaaaacccagtgaccctccctctgcaggagtcgctgcatgacctgaggtgggggctatagcttctttcctactaggtggaaagaaatgtagaagaagtggctttgctgatgtagaattgagtgtcagaggctactgacacattgcttttgccagagtgcatttttttccctacagtttctttagatgtgatacttatttctattacaaaaaaaaaacaataagcctacttttgatattttaattttttcaaattacacatgccaagaagaacaagcagattatatatgtacacacacacacacattttatactgtctgctcagggaagcaagcagatgttacaaagacttgtttgtttgccatgaatttagaaaatttgaaaacttaccaggagctggtactttaattttgtctttagttacagaagggaggaactagagcagttgttttgctgtgtcacatagttgtaagatatcatctgtgacttttgtcctcagctttctctgcttttctatccctactttctaaagataattttgttccacttccatctctaaatatcactctctttggggcatggtggtggaatgttgtgatgtgccactcagatccttcttcaggaacaaaggaattatcatgtccatggctggcagagctgtccccaaaatagccatgagttatcagccacctcttggaactgccccaccagaagagaggcacctcgccaaggtaagaacctttttgtggcaccactggcagttaatggcaaactcaagtgaggggctttggaggacatcctatccttgaactcagaagacttgcggaagctcatttcattttcagagcttctctgttggtcttgaattaaagttcaatctctcctcctgctcaatctttctttccctttcttgtcacagctcttgatctgagagcactctgggataaccttctcacaatgaatttcagaatgtgactcctgatgaacccaactagctacaatcttacatccatgtctccaactttatttccttgaacttgagtttcaaaattcaaacttttaaatcaacatttctgcttgcatttctaagtaatttcaactttaatatgctcagaaatgaatccttgatttttacgccaaaatctacttgtatcagaactacactgctcgatgaatatcactgccagtcatctagatacttagaccccaaacctaagcaaccttgactttgatctgttcctcaaaaatccacatcctattgatcaacattctgtcagccctgcctctttaatgcatcccaaacccaattgcctctcaccatttctactgctgtaatcctatccaagcttcaatccgttctcacctggcatatgcccataagtctcctaattgtatcgctgtctcctttctagtatgcttagatatgtcttccactggcagacagagagatcttatctaagacttaaatgagatcttgtcattttcctaactcttgctaatgattttcctttccaagaatcaaatccaaacttttcaccagaaccccatatgatgaacctctacttacgtatctcatgatccattgataggctcactacttctcaggcatgttgcctttctctctgtcttttgtacacaccagttctttttcatcccagggcatctgcaattcctgcttcttgggaggcttctctcccaagtatttgctgggtactttttctatcttctcctcccttggatctcaaatgtcatctcttcagagaggtcatcctgaccacctagttagagcaacttctaagcatcttctttacaccactcgttagtcttaaatttgttatttctggctaaattatgtccccacaaaattcatgttgaaactctgactccagtgtgtctatatctggagacagggcctttaggaggtaattaaggtcaaatgaggtcttaaatgtgaggatctaatctaataggactgtgaccttgtaagagagagagatgtctttctctaccacgtgagcacacagcaagaaggctgctgtctgcaagccagaaagagagccctcaccagacactgacactgttggcacctttatttcagacttccagtcttcaaaactgtgaaaaaataaattttggttatttaaaccacctagtctgtgctactttttatggaagattgggaagattggggtaccatctgtcttgctcactgctatatctccagtgcaaggaacagtgcacttaacaaaaatatattaactggcttggtgactgttgcctcaaaaattatttaagttagaggtaaaagacagagtatgaaaaatttaagtgctattctttccggtaatatggcaggctatatatctaaagaaactcccctgggctagattattcaagaatcaggttgaagtatgaaatatctctttaaatttataaaatagtgagagaaatacttgagacctaaaataacggaaggactataaacgatgaaagataatcaagcactaaattttggcagttgctccaagagatacgctaatcactagagttcaggagagagatgtatttgtgtatattctagtgaaaaagaaaagttagatacttaaacaaaacatggaaggacttctagtattcatataagctaaagaaaaatatttcaggaagttggtatatggttatcagacattgataaaacaagccaactgggagaaatgttgaaaaatttctaagtccagagtcaagattggaaaggtgaagaaaggagaaatcctttcgtggctttagtgcaagaggaaggggttttaatataatttttaaataaacgatttctttctctttttttttcttcttctcctttttcttgctccaactcctaacctcctcttctgtttctctctcatttttttctctcatttattttgtcactatttcattcatttactcaattaggagatatttcatggaccccagattttatgaatcactttctaggaaagataaatgtagacaagtgatctctaacctgtaaagagcttgtcgtcaagtcaggtgtgtgtaatagttacatcaatgagagtgtacgtgtgtgtgtgtgtgtgtgtgtgtaggtggtgggtaatgcagggaaaggaagtgggaaaaggaagaaaaaagaatatttgtaagtctggtattaactttaaattttatcatttccttttgccaacagctatcttaggatagctagaagaaactcctatgcattttgtgtattatgatttaggtagactgaatttttgctatcacttaaaggcatcctgtcatttttggttgaccagagctgattctgttatttgaggtatttttatacatattctaaggatagcttcgcttgttttttagttcttgcaagtctaattctggtcttaatagagaggtttctgtttaatgaaatggtagagttgagtttattaaaacaactacttaaggtacttttactctcattttaaaagctgaggatccaaaagtagattttatgttctttctcatctggagatataaaaatgttattaacattcaactagtctcaaaacccaaagttggaacccggggttgtttgaagaggaatttactggtaacaatgtgtggactgaaaatgagagagctattcaagtagtgtgctttgtggtggttgaggtttagttaatcatggtccttcaccatcaaagataacaaagctttggtactgctctgcacaatatcaaccctttgtattttcagatctgctcactaaggttgaattttatcattttcttgctcaaagattcaatctccattaacagaaacccactaagaggagtgcattttgtggcttcagcggcctaccaaaccaaacatttgcaggtcaactcaggagaagaaaaatgatctctttcaagatgactgttactgcacaagcagaaaaatatcacaaagcaggatacctttttatagataaattttaagtcatcagcattatcagtttttctctataatccctgctaattgtaaatatcaaattgcattggcagaatatggctacccagtaaagattagtgctttatccacatattattataaaacagttatcaaataatatattatacttctatttttcttatatttcttggccttctatgcatcacattttcacaaaatctcacagctgttacctaacttgagagtgtccatatctgggttttgcaggcctagcatccgttgaatctaaataatacacagcacattcacatttgattatatgaagcacaggaattcagtacattgctgtgtaggtagtttgttgccctggtgaatcatagcataatattaggatgaaagagatgggtaaaaggatatcatagtaatggtgatctgcaggaatcttgggctgttctggagatgaagggtaaatgtagtgaaatggactaccagtcatgatagttaaatttgtccaagggtcctttcctgtgaacagtttctgaggtctgtaactggcttgtagtcagggcaaatggatattcagtgtatgtccagtgaaggttcagggagaatgggaagaacactgacaggcagcaatgtatacctattatttaaatactgttcccaaatttgcaagttcataaaaatgtcactttcctatcacagaaggtccttttagacacaatgttttattactttaatatctgctgaattctgttgatattatttctgctgttttattattttaatatctgctgaattctgctgatattatctgctgaatatctgctgataagtatttcttcaaagtataattgtaggctaagtgcattaacaaaggatttccttttccagaactatttaaattgaatatttcagattgcagtggagtaagttccatgctctgttgacctgcttttttgagcaacatacttttggtcaactaccatcataaaggacagagatccatgtatgcagctgcaagatgaatgagaccttcaatctactggtgacactgcttaataataaagcagttagtaaagaaagaagaggcaaaaagaaaaaaaacatagcttttattgacaggaaggaattccagctgtttggacagttacgtattgtttaatagggtagattcttttaaaacctgaatgtgacagatatttacccaggctttccagctgaaactgaaaatagggtcacaataatcataaggaacagcagaatctatggaaccccagttctcttctatatccctccctgctagtttaatgagtccttagggagtctctcatgagcacctagagggccacaattgtccttttctttctacatttagtgcccatcttctcagctgattctgacacccatcagatagatcacgatttgctctactgatattctctcccactcccaatgttggctgccttggttggctatcaaaattgtcttactagcttgctggtcatttccacaacatcttattatgctacagggtagatgaactgaaatggaggtaaatatccttctttgcttgtgttacactttgtatctaggctaaaagcaggacaaattttatatatatgtggccaggaccacgtccatcaattcctggtcttgggctagaaaagaagttaagaagatatatattgtagttcattcatatttattctccctttacaactttcatctgtgttcttagaacaagtttgaaaaacttgattcactttagtctcagagtgtctagttctttatcttctacagtgtctgatagggaaaatggataaccattagcctaactttttgatgccaatttggagcttgaagttaactgtcacaatcaacacagtatttttttgtatatatatatatatatatatatacacacacaaaatatctatctatatatattactgctccttgcagagcagggctatcctctaagcactgtgcccagagaagcctttttttatgtttttttttaaacaagcaattagtctccatgcaaatataattaatatcagtataatatgttatcctaatagacattgctaacataatggaagttacaatgatacatggtgtagaccggttataccagaggtttttgtgtgtgtgtgtgtgtgtgtgtgtgtgtgtatcatttatctagacagagcaagtaggatttggtttctgtgcctggatcatcacattgagaaagattgctcagaatgaatgtgtgattgattaattacacctctcatggtgtcagtggtagaacaactatataattgccacccccaagctagagtgatggcttcttacactagtttacctctcactcctcacacagcccctccccaatcctgggatgtaatgaactagtttgatgattaactatttaaagagctagagcaccataattataatgcaaaaaaatagggagaggaattttacataaaattaaacataatattgaaagacgtacatttctactaacaagttggatcctaatcagatgacttcatttttcctaccaaaaaataaagaatcatgagagaatttggctaagtttgtctttactcttccctactttctgtggtcttctagttcatcagtggtataacttagatctctctcatattctgaatctctctccatctttttcaccttctcgttgctaaaacgtatcttagaccataactaagggttcattttagaacccattaatcatattgataaacaaatgattaacaggttcaataagaacctgttaattactatacattactatgatactatacgttactatactacttacatactatatgttatatatactatacgttactatactacttggaaacttggaaacttttctattacaattggaacctgttaatcatttgtttaccaataacaggcttttattgaacctgttaatcatattggtaaacaaatgattaacaggttctaattgcagtagaaaattttccacgtattatatctttcaagagtatacacatttaatatttttattcaataattgaacaaatttactgaaaacctcgtatgtaccagatacttatctaaattgtggggatgcagtggtgaataagaaaatcattgccctcaaaggacttatgttttagtttggaaagacagactgtaagcaaacagaagataatggatggtggtaagtattattggcccttcatacccatgttccacatcagcagattcaaccaatcaccaatcagaaatgtagttaggcttgtgatggttgcatctgtgctgaacatgtacatactttctgttccttgtcattatttcccaaacaaggcagttataaccattatttacatagcatttacattatattaggtattgtaagtaatctagagctaatttaaagtattccagaaggtatgaatgggttatatgccaatactctgccatcttatgtaagatatttgaggattttagtatctatagggagtggggggtcctggaaccaatccctgaagataccacaggcactgtgcagaggatgattacattaggatgatgtgaagttgaaaaatcagttaaactaggatgattgatcagtgtgtaattactccaagtggggtcattagaaaagacctttctgaagaatgacagttaaggtatctgaataaaaataaggatccaggcatataaaataccatagaaaacacaatttaaatctaagagtagaattttaggcacagtaaaatagataggaagacatttagagaggatgaaaacaatcttcatggccctgaaatcacactatctaatgctcctcctacatgcgcaatccgtccttattagtacatgcttcctaaatgttattagtatcggtccgataaatctcttaaatttacaatgtattaatttgttaattaaaagagatcatcatatccttgactaaagaagctatgtttaatagccagagagaggaaaaattcacctgcaaacacactattattctcaagagcaataataaagtcagaagactatggaataatgtcttcaatatgctaagagaaaaatcaattacaaattagaattgcaaacctggaaaaatgtgttccaacaatgttttttcaaaagaactaaagcagagggttaactgccaacagattttactaaaggaacatctaaagcaaacatttcagaatgaaggaaaattattttaaacatatgtagatgcataaataaatagcagataaattaataataaaatgttgtataatgtctgatgtctcagattgagaataaaaagaactgaaatactggacagaattagcctgtaggttgagagtagtttcattgcagttaaaatgatttatggttcttatcttgctcaggaggaaaattgcaatattaataaaacttctgtgcagtaatattgcaaagattacattaaaaaatagaagtagaggatataacttccaaacagtaaaagaaaaattaaatgaaatgagaaaacaaaactaaccaatccaaaaaatacaagagagaagaaaaagaagtatagaaaaaaaatgtggcaaggtgtacaaagtaagagggtgaaaaaattcagatatgtcagtagtcacaataaataaaaacagagtttattagataggtttaaaaataaaaaatatgagaataaagatgaataagtactagagatctaatatataccatggtgactaccgttaataataatgcattgtatgcttgaaatttgctaaaagagtagattccaagtgtacttacaacacacacatacgaaaggcaactatgagaggtgatgaataatatgttaattagctggattgtggtaatcatttcacaatgtacaggtatatcaaaatgtcatgttgtatagcctaaatctacataatttctatgtaccatgcctcaataaagctggaaaaatccaggaatagtctgataagagaaacacttaaaagataacttgagaaggtagaaaagaaagaaatgtaaaaagaacttgtgtaactattttaatatcaacacaaaatatgcttaaagttaaaagcatcagtagaaatagaaaagatgattaaataatgttgaagagctcagttcaccaggaagatattataattctaaacctacatgcactaataaaatcagttcaatatatatgcacaaaattatagaggaataagttcataaacacatcaccatcatgaagtgtgttaatacacctctttcctttcaaaggtcagacaaaagacagtaaattataaaaaacttgaacatcataattaatatgcttaaataaatagatatgcatgaaatcatccattattataaaacatatcttgttctcaaacacataaagaatatctaaaaaaattaattatgtatgtattattaatccataaagcaactctcaaacttccagaaactgatgtcatgcaaacaacatcacactggtatcacatagtctacctcagggaaattagattagaagtaaattgcaacaaaaattaacatatcaaaaactgaaattaaaaatcatatgtctaaataattcataggtcaaaaaccagaagtaataaatataaggtactatgaagaactggatgatgatgaagttaccatatatcaagacttatagtatagtatgcagtgaaagcagtattttaggagcaacatagtgtgaatttgccagtatttgaaaagaaggcaaaaatggaatgagtcagatatctaaattagcaaataaagaagaataatagaataaaccccaaaagaataatggctatagtaaaaaaaatttataaactagcaagggcaaaagtggtttctctaaaagacaatttgaacaaaactctgatgagactgattgaggaaaaaaggaaagaagttacaaatattattacagcttgaaaaagctcataactacaaagagcggaaattgaaaagatagatttttttccaggcaaatttatagaaaatgtttgagagtattaacaaaatagatgaattcctagaaaatatacaatatcaaaactgacagaagaggaaataaaaagttggctgaagagataataatttgaattgccctaaaatcagtaattaattgaatacctagtaaaaaatattttcacagagaaaacaactgcctcagatgactttacataccagttatactaagtattcaattaagatacaataattctcacaaacttttccagagaatagaaagaatgataacaggctggacgtggtggctcaggcctgtaattctagcactttgggaggccaaggccggcagatcgcctgaggtcaggagttcgagaccagcctagccaacatggtgaaaccccgtctctactaaaaataaatacaaaaattagccgggtgtagtggcaggcgcctgtaatcccagctacttgggaggcggagacaggagaatcgcttgaacttgggaggtggaggttgcggtgagctgagattgtgccattgcactccagcctgggcgataagatctagagtttgtctcaaaaaaaaaaaaaaaaaaaaaaaaaggaaagaatgataacaattcccaagtcatttaataaggtctatataaccttgattctaaaggtaaagaaaaggagagcatgagaaagggaaaaaagtggttatagaatggttatagaagacagaaatataacacaaggacaataatataacaaacattaatataatagaaatgacagtaatataataaaaaagaactgtatgggaatgaagaatacattccaatctcatagttgaaagtctgatcatttatgtattaaaaacatataattcatagtgaacaagttaggtttatcccaggaaaaacatgtgctttaaaacaataataattatataaatttcattcaccatgaaagagaaaaaatatgattacctcaatcaatgcatgaagatatttcataaagttcaacattccatccatgataaaaatttttatcagaattggaatagaagagaatatctttatcaaaacctaccaatgatggatgtcaaatacaaatctttttcaaaattgtattttatttcaatagtttttggggaacaggtggttttttgttcatggataagttatttagtgatggtttccgagatttttgtgcacctgtcccctgagcagtgtatactgtacccagtgagtagtcttttatctctcacctctatcctacctttccccttgagtccctgaagtccattatatcactcttatgcctttgagtcctcatagcttagctcccacttataagtgacaacacatgatatttggttttccattcctgagttatttcttttacagtaatggtctccaactccatccaggtggctacgagtgccattatttcattcctttttatggctaagtagtagtccatggtgtatatgtaccacattttctttatccactcactcattggttgataggcatttggcttgtttactattattattattattattattattattattattattattattgcccaggcttgagtgcagtgtcacgatctcggcttactgcaacctctacctcctgggttcaagcaattctacctcagcctcccaagtagctgggattacactcatctgccaccacacccggctaaattttttgttttgttttgttttgttttgttttagtagagatggggtttcaccatgttcgccaggctggttttgaactcctgacctcaagtgatccacccatcttggcctcccaaagtgctaggattacaggcatgagccaccgtgcccagctgcctggttacaattcttaacagctaaatagtagaagtgttccctgtggaattaggaacaagacaaaagtattcaccatcacctcttctatttagtgttttaatgtaggttctactagcaagacaagaggtaaacgtaaaatatatggatactggaagaaagaaggataattcattattcacggatcatattattgtcaacttggaaaacccaaatgaatctgcagacaacctataagaattagtaacggagttaaaaatgctgtttagatatggtaaaatctatatagaaaagtaaattacattttaccagagtctatttataaaaacatgttatttatcataaagctcataaaactaacaaatgcatctaggaataaacctaaaaatgaatgcctaaggcttttgtggagacagttataaacttttaagacagatattaaagacatctaaaccaaagaagaaataaaatcatgttcattgatagaaagacacaatgtcacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagacaccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcaattcctcagggatctagaactagaaataccatttgatccagccatcccattactgggtatatactcaaaggactataaatcatgctgttatacagacacatgcacacgtatgtttattgcggcattattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggactgttgtggggtggggggaggggggagggatagcattgggagatatacctaatactagatgacgagttagtgggcgcagcgcaccagcatggcacatgtatacatatgtaactaacctgcacattgtgcacatgtaccctaaaacttaaagtataataataataaaaaaaagacacaatgtcaccaaggcataaattttctgcaaattgatctttaaatacaatgcaattccagcaaaaaattaagatttttaagaaacttgatgtatttattggaaaatatatatatagatgaagagggtctacaggtgagccaaaacctttctaataaagtataacaaaaggtagatttactctgtcagaaagtaaggtatttttaaagcaataaataatcaagagagcctggtattaaagcagggatagtaataccaagaaatgcaactaccatggtttcaatttctcctgcaaaactcgtgttgaaatttaattgccaatgtaatggtattgggaggtggggtttttgagaggtgattaaggctctgccctaattcatgaattcatgctattacctcttgggaatgggttagttatcctgggattgggctcctgataaaaggacaagtttggcccccgtttgctctctgtcttatgttctcacataatattctgccatgggataactcatcatgttcttggatttcctaggctccagaaccatgagtcaaataaacttctgttctatttataagttacttagcttgtggtattctgttatagcagaagaaaacaggctaatataggaacagtatagagagaccagaaacagacccataagtacatgataatttgatatatgatagagatgtaattacagatcactggggaaatgtatgactattcaataaatggtgctgagatatttggttacctatgtagggggattgactatactatacacatagcatcatttccaaagatattaaaatgagcaggtgggtgtttgtgaaatgatggatatgttaatttgcttgactgtggtgatcatttattgtacatatcaaaacatcatgttgtacacctgaaatacatacaatatataaaaaatgcagttgaaaaatttaaatgggaaaggcaaattttaaagtatttagaggatagtataagggtgactaccttaatgagttcaggatatagaaaagtttttaatgaggcataaaatcactaaatacaagaagaaagattgatttactgctttgaaattattaactctttttatcagatgacatcacaaagactaaaacgttaaaacctgaaaagtatatttctgagatatataactgaaaaagaatttgtatcaataacatataaagaaatattacagattactaaaaattaacaaaatactaataataaaatggtcaaaagatatgaacagacatttcaacaaagggaaaacataaacagaaaaacatatacaacagaaaaacttacctgtgaaaagatgctggatcttattataaatcaggaaaatgcaaataaaagctgcatgagatacagcttaacacacacaagttgccaaaaacgaagaaactggagaatgccaagtgttttgagtgctccaatgttgctgtgggaaactatatggtgcaaccactaggaacatgcttttctgcatgagctacaaccctgcaaatccacttcttgatatatacacccgagaaactcttgttcatgttcaccaagagatgtatacaagattttttagtagaaggattgttacagaaaaaaactggaaacaaaccaattatttatacacagaagaatacattttgaaattatggttcattcacacagtaaaataacaatgaaaatgaatgaaccacaaacacagaatatgattgaatctgagaaataaaagggagttttagaagtctgtatacagtatgatatcacttttataaagttcaaagccatgcaatattgtgttcagatatacatatgcacatgcaataaaagtgtaaataataaggcatgataaataacaaaaccagaacagtggttacatagaaggcttgagagtgagttgccaggtgttttgctattatgcatcacaatatgtatgtatgttatatacatattttatgtagatatctaatgttgcaaaataaaactgaaaaattgtatttgtttttcaggataatagttctttaagaaagaattgggaatgaagaatttagcaaaataatgattttgaggatgactgatattttcattaagtcactctgtatccctgaatttcagaaatattagttggaaatggaagtcactaacataacctgaacacaagctgtaaactatataatacagatgtgaggttcttgaaataaaacaccatctgcttacttgtaagtagcaacaggagaattacactgcatattcagatgactaggttcttaatctacctttgctgttggcatcctgggcatatttggacaacttgcctactttccttgattcattttaaccatccatggaagtagaatatgaatctgtaatgttccttttgatttaaagataatactggtgccattctttgtatcttaacgtttatttttatgttctgtttttattccttctctccccagagaaaacacctaagggctgtgttacaatcacagtgataatcaattttatctttacctagataattataggactccgattgtggctggtataagctatttctagcataacttgtggctggttctagctctcctcttagagagatcttaggtggcccttgttttattttgatgaccctgctatgaccacggaacttcagtatgtgacaattcactcctacctcaagatgtcctggtggtaccttctaaactagcacctcccattcctttatggaaatgtgcaggccttcatttctcttgctttgtctggcaccagaaaatcagttattcccaaatcccttaaaatttttattccacaagtccttatggaaatgggactactggtagcttgttcagaggtcccggtgtccttgagctatgtaagcagttagaccacaccatgaatacattagttaagcactgcctcaataatgctgtgtaaaagcattcaaactcagtggcttacaatggcaagcatttggttttgtcactgatttgtgtgtagatctgctggtctgggctctacaagcctccatattcttctgggatcagaggctaccttgggcatatcgtttttttggaatatcataggcatgcaaaaagccaaaccaaactacgcaaacatatgtatggcctttactttagtcatatctactaacgttccgttcgctaaatcaagtcatatagcaaatgtcaacatttagagggggaggagaagaggagagggaaggggaagaaaacaatatatatgtgtaaagtatattcttttcccattctaacacattgcaagatcacatgagtaagtgaataaatgagaacaataatcgaatccaccaaaaagtccccctgaatattatatgttataaagtcaaaatagaaagtcaaaaagaagcacttagagtaaatagaaaagactttcattgttttttgttgacttgcaaccttcaacctggtttcacattattagtttgggttaagaaccatcactaaggtggtagaaatcaatagatttccttgatttacatatactttagagtaaaggtgtgttcaagtgagattaagtcagcagataatctagacagtgacaaataaaacaaaacattttctccagctatgctgacaatggattggagggaataatctaaaatgtgcatgatgaatttgtggtctaatgaatgacaatggaggtgtggtgggaagagctcagactttacagcgagacaaatctgattctgaactctagccccaatgattgtcagctttcagcaacttgcttagattatctgagactcataatctttgcctgtaaaatgaggattatgtcatctctgagatactgttgtgatgatctttaaacagttatgtgaaagttttaatataatatctgatatttgacatgcaagaagttgcaactatcattctggaagcatttataagatacactaaagagcagtttagacatttctggatgtcttttaaaataatttctttcttctaatatggctaagatataatttcacttgaaaaaagatgatatcctcctagaaactcttcaaaatcttgattcaatgattccaaaaagaatattatttattcatttgagaaaaccatttgccacactgctacatactttcagatgtgaaaataaagggatcgcagctggttgctttattttcaaacaactacaaaggaaacagtagaattttggcttcttgtaattttcctttgaaaatgttcacaaccatgtgtggttggaatctggcatttatcttttgcttccattctggaaatttatacacttctgtagcgtttggtttgggtcacataacttttcaattctttgtcatagtcttccacttgtataatttccgtccagtgtgaaaaacatataccataaggtgtttacacagaaagactttaggcataataattgcctatggatcagaagagctagcacagaaaaattagtcatgcataataaggaaacaaaaaatgtatcacattattttatgtgaatgaccaagactgagtgtacaggatgtaatcaaagtcaaacaaactttgtaaccattgactttagaagaataataaaaatacattatccagctcccatacataaaatatactagtttccaagtggacagatgagtcctgccaaattttaaatcgtttaaaaatttattttttagagactttcaaaagcagctttttaagatcatctaggtgatgagagttgatgtcagacacctatttccttgctctctcagttctttattatatccatgataactgctctgcttatactttgaggagaaaaatgattctcgacagaagtttataaggaaattaaatctctggagattttttttttttcttcaaaaaaaattcaacttctactgtccttactggaactttttcctggttctgttgcccatattttgactacagctttctcaaagctgaattttatatttccatctccttgtagatccctttaactttttatttcatggtctccctagtctaattctgatcctcactaccttattcttgacatcgactctttctctgcctagggaaacaggacctgcctctgactgacttacaatttttttgagtcaaaataatattattatgagtcaaaagtcttattttgttcaacttgattgatagagagcttgatttgtagaaccttctagcatcagtattggtcatccatctattctgcatttactgagtgccagctatatgccagacattctaccatgccccaaaatacagaaaaagagattagaaaaccagcaattgcagcctgtcagcacttgaatgagatctgctgcttactagttgtgtcaccttgggtaagtttcttgaatctattcttcagtttgttatctgtaaaatgatattagtgccctatgtcatcaagccgttttgaaggttaagtaaggcatatatgtatattgcttcgagagtccatagattattctgtaaacaaggcaagtcctgtggcctcagacctgtctaatcaccactcctgtcctggtcttttgccttcactggacttaccatttatgtcaattaaacaggagaggcagttgatattgaaaagtaggtgcaaacattgcaaaacccattaaaagataggtttttgataatctgtttgttctcatttgcagaatcccttttaaaagactttgaagttcagagacagatactatagttctgacttgtaaggggccatacatatcctgtatcacagctaaaaatggtataggctcatctggcttttaaaaagaagaacttgagcagatattaatccaaagaagacatacaaatggccagcaagtgtatgaaaagatgttcaacatcattaattgtcagggcaatgcaatcaaaactatgagaatttatcacctcacacctgttagaatggctaatatcaaaaatccaaaatataagtgttggtggggacttcgaagaattagaacacttgtacaccattggtgggaatgtaaaatggtctagcagttatggaaaacagtatggaggttactcaaaaaaatttaaaaggaactaccatatgatccagcaattccaaatctgggcatatatccaaaataattaaaatgaggatctcagagagacatttgcacactgatgctcattgcagcattattcacagtagccaagatatgtaaacaacccaagtgtccagtgacagatgaatagataaagaaaatgtggtatatacatacaatggaattatttagccataaaagaagggaatcctgccatctgtgacaactggagaacattatactaagtagaataagccaggcgcagaggggtgaatatactgcctgattctgcttacatgagatatctataatagtaaaacttacagaggcagagaatacaatgcagttgccaggggttgggggtgagggaaatagggacttgttcaatggatgtaaagctttacttgcgctagataaagaagttatagagatctgctgtataacataatacttatagttaataataatgcattgtacagttcaaaatttattaactgggtagattttatgttaagtattcttatcacaaaaatgggacacaaagaaactttgggagtgttgggtatgtttattaccttgattgtggtggtgttatcactggtgtttgcatatgtctaaactcatcaaattatacacatcaaatgtgtgcaggtctttgtatatcaattgtgcctcattaaagctgttaaaaattttggcttcatttgataatgagggctcttcaaaaaggctgatcactgcttacaagagagaacatactttgggctgcgtactgtctttatgtgagtagtcctcatatgtttacacttctttgccttatgtttatgcaatcttataacagaatgagatagcattttaacactggtaaattaatatgtggcctgggagtgtttagatttagtagaattaaaatggtttaaattgctaaacaagaacagtattcatgatccaaatatattacttttgtatatattgtacaacaaaccattatttcattacttaacttattaagctgacagttattaccacagactaggcacttaggatacagatatagaagacagtttctgtcttaaagaactaatcatttaatgtaaaagatatatctgaaaataaatgtttataagcacaatgataacactagtatacacgagctatacatggatattaaagaactgaagagggaccaagagaatgtgtacttattgcagtgatttatggtcattggtttttcttctttaacttattagatgctgcacaaatatggacaacattctgtagcaaagctaagtacacgtttggaacttgcttttttctaacatgaaattttatttttatttgtttttaattttttgttaccataggtttttggggaacaggtggtatttggttacatgataagttctttagtggtgactggtgagattttggtgcacccattacctgggcagtatacactgaacccaatttgtcgccttttatccctcgcccccatcccaccctttccccacaagtccccaaagttcattatatcatttttatgcctttgcattttcatagcttatctcccacttatgagtgagaacataagatgtttggtcttccactctgaggaacttcctttttaaaatgaaggagctaataaaattggcttctcacattgtaaaaaaaagtcatgagaaaaacaatacattatgaattgattgttatctctattttgtagtaagtgagagttttgcttttccttgaattactgattttttggctggttgttttgttctttctgtgctgtgcagatacaaccatacgtggttgtattttgtagtctgaagaagtttgaggtgatatgtgcttgggatgtctcattagaaaaacgtttgggacaatagagagaaaaagaccactaaaatgggaagactcatctcttctttgcagttttaccagaaattggagctcttaagtaataaacaaccatcaagtaattaaagaatgaaaaatgtgattttcattatagcatgaattgtgtgattcttctctatttttcttttcttgccaattccatttggtatgattgtgaaacgccattaataagcattgtaagtcctttcatttcagaagttcattttggttaccaataaatgttttgtgtaggactaagtggtatagtttaaaattttttttctcttctcaaaacaattagtttgctgaagtcagaaaatatgttacctgagtttaattctttctgttgaagactattctgtaaccatttggacatttatttacttcatatggtcaaccacctctcttcatttgatcacttctacattaaaagtctataacatggtatttggggcagaaaatgtaaagaaggataagtcacaatccctgaatatcagtagctttccacctagtagaagaaactgaatgcaatgatatctataatacagataatatttgacaaacgctatgatttattcattcattgaacaaaaatgttttatgcatctctcatattctgaacactatgggagattctggggatagagacatgaagaaggcagagacattttgtgacctcacagcttggtgggaatgacagacatttaccaagaattaaagagccttcactatgggccagacatgtaagaaccagagatagaaaaccctgagtaaaggtgctgataacttaatgaagaagagcaccagaaaataagcaatgactaagtattatgataaactcacaaaaaaggtgtaggtaggacattacaaaaggacataaaaaatgaagccatcatcctattttctaatcatgtatttccatacgttgttttattacatgctatataaatatgggcaacattttacaaatgcttggtgagtgacttattatatgttatgttgaatgtcacagagtgatatgagaatgtagaggaaaaattactctctttggtattttcagagatagttttctgaaagacctgtcatctgaggtcagttcttcatgaaggactggtagtattcaggagaggaggattccagattgaggaaacagtgtgagctaatgtacagaggcaggaatttagcacatatagaatcgtcctacgtggatagattgattgtaggattaaagagtgttaagccagaggtgaaaccccgtctctactaaaaatacaaaaaattagtcgtgcgtggtggtggcgggcgcctgtagtcccagctattctggaggctgaggcaggagaatggcatgaacccaggaggcggagtttgcagatccgagccgagatcgcaccactgcactccagcctgggcgacagagggagactccatctcaaaaaataaaataaaaataaaaataaaaattaaaaaattaaaaagtgttaagccaggaaaagcattttctaaggcttttccaggtcttgaggagccttctataccttgtaagaagtttaggcggtatcttgagagtaaacttcaacatcgaaggcaataaatggaaccaggaagacatccggtacccacaaggaggtgtaagagacaaccagaaagaggcaaaaaggacaaagcacggggaatctggggtaacatttacttctagcagttttaaaaattttcttaaagttatgtatgacgtttattcactgagtcccataatttttgttgagagatgaagtatcatatactttactaagtattattgggtcgagaacgtaaaaaattcaaaatagggtataaccacaaggcaggaagatacattaccaactcacagtaatgtaagtgagataaatacatgctaaaacaaaaggagcacaatgtgtacaaaagaagcagttaattctgaacaaagtgattgagaaaggatttgtggacaggcagtctgactctagagcctgatggccatgatgtgtgttgggtgtaatcactggctctttgcatcttggatggagttccttgggaccagattctgataagaaaagttgatgcagaagatttataggataagacttttgaaagaaagagaaattgacctgtggcacaggtgctctgaggagttggtcaatcctcagaagctcttgagctaggaagacctttcagaggtgcactgaattgaggtaatttggccgtgtctttatatctgtgcatctgttagtcattggcaatgggaaattccttggaaaggttataaccttggggaagacagttttctgcaactaggggcaattcccagtgataaatagagctgggagctgcgaacaatgtttaaacttagatgagcccaatatggtaggtggaaacccaattccatgctgtgcactttccttttaatttttgcattgaaggctatagaaagatgtaaaaagatttgagaatatgaggtggcatatatggattttagttttagaaagttatttctggtagtactataatgtataatttggtgaggtgatatatgctgacaagtgaaacccatttgtagactattgtaataggtaagttccaattcaaacctgtgtgaagttttcccatatctcagccagaatagtcttctctctaccattctcccattagttatatttttattttagccccaaccaaacccaatttatgccatcagtagttgtatctgtgtatgtcttgttgtagtctgtgaatttctttaaagcaatagccatacagacatattcttgtctgtatctctcaaaggaccaccattgagccatgaataaaatgggcattggtaaaaatattttgaattaaatgtttctttcttttcttttcttttgatacagagtctcactctgtcataaaggctcccaggctggagtacactggtgcaatctcagctcaatgcaacctctgctttctgggttcaaatgattctcatgcctcagctccccaagtagctggaattacaggagtgcatcactgcacctgactaatttttatatttttagtagagatgagggtttcactatgttgcctaggctggtctcaaattcttggcttcaagtgatctgcctacctcggcctcccaaagtgcccagcctgaattgaacatttcaattgcattcagggaagaaataataagcttctaaaactgggttaatagtagtaagaacaaagagaatgtcactggtgaggaacactaaggaggtagaaagtgaaaaaggacttttgggcgtgatgacgtaacttctgtaatatataaattatttgtatatcaaatacactgaaacacactactagaattcatttatgtttatatatttatttggtacattttcccaggccatttcttaaaacacttcccctctttacataagtttctcaaagtttgtttttccaatttatacttcaaagagaaaacataatttgaaagttgtttctaccctttgatgttgttttataacgcttgcctaaggcattaaagttcaggttaacagttctgtcttagtaaaactgattttgtaagatgcttttctgcccatatttcaaatgaatgctttgaattcctttgccaactctgtcaaggttatatgactccagaaggccatcaaaacttccagaaagtcaagaataaaagtatttttctttctcggggtatgatttggtcaagaaaagacatgacctatgaaaattaaaatatatcttggaagcatgaaaatggctttgattcaagtgtgtaaagttttccaaagctgagagggagcacatttaatctgtgaacaaagacattataatctggtggcagacacatggtatgtggcgtcagaaaacacagactgacaagttatatgatcatgggcaactcaatgtttctatgttttattcttctcttcttaagaatgagataacattatttcttgttgtaaccaacttgtcagaatgatgtgaggatacaattagccaagtgaaatacatggctagaagaagcagtgggaagagccctgtgggcactctgggtccaaagggaagccatttttgactttgtctcacaggggtccttggagagagctgccagtggtttggggaaagaccacagggagaaggaaacttccatctgaactttgtaataatttcgatctaatgtgaagtttcctggatagaatctaggggagggggtgaaaggggagtgcagatatgagcacagaagccacagcaggtggtgggcaggattcctgaaagccctgcttgctttctcagtggggaggcttagagcctagggcaagttctcagcttctcagccctgctcatctgctgcctggaaataaaatcagtgctattgcgggggcggggggggaggggtgggaatggtgggaatgagaccagccttttggctgtgtgggagctgggtgaggcctatcactgccagcttttccccacttccctggcaacctgtatgacacagcgagggtgtcataatccccctgaaaacataactccataggtctgagagccatacctccatcccctacagcagccacagcaagccccacccaaggaaagtctgagctcagacacctctaaacctgcccccaccttagggtctttccctatctaccttggtagccaaagacaaaggacgtaatctcttgggggctctatggccctgcccaccaactgagaaacccaaatatttatccaggcaaccctagggcaatcttgtgtcctccctatactattgcagctgatgctctcctgaaagtgccacctcctagctggaggccaaacaacacaaaaccaacacactaaacaaaactataaccaaggaccctcacaaagtccaattcactcctctgctacctctactggagcaggtgctagtatccatggctgagagacatgaagacagatcacatcacaggactctttgcagacactccccagtaccagccgagagcctggtagctctactggctggtgaaactcagcagagaaataacaatcactgcagtttggctctcaggaagccccattcctaggggaaggggagagcaccacatgaagggagcaacccatggaacaaaataatctgaacagtagcctttaagccccaaatcttccctctcacataggtctacccaagtgagaaggaaccagaaaaacaattctggtaatacgacgaaactaggttctttaacatccctgaaagaccacatagctcaccagcaatggatccaaaccaagaagtaatctctgaattgccagaaaaagaattcagaaggttgattattaaactgctgaaaggtgaatatcaacttaaattaaaaaatgttacaggatatggatggaaaaatctccagagaaatagatagcataaataaaaatcaaacacaacttctggaaatgaaggacacacttagagaaatgcaatatacactggaaagtctcaacaatagaatcaaagaagtagaagaaagaatttcagagcttgaagacaagtcttttgaattaacccaatctgacaaaggcaaagaaaaaaatgaacaaagcctccaggaagtttgggattatgttaaatgaccaaacctaagaatgattggtgttcctgaggaagaagagaaatgtaaatgtttggaaaacatatttgagggaataataaaagttctccagccttgctagagacctggacatccaaatagaagaagctcaaagaacacctgggaagttcattgcaaaaagttaataacctatgcacgtagtcatcaggttatctaaagtcaagatgaaggaaaaaatctgcatcaggtaacatataaaggaaaacctatcagattaacagcagacttctcagcagaaaccttacaagctggaaaggatttgtgccctatctttagcttccttaaacaacaaaacgataaacagccatgaattttgtatccagtgaaactaagcttcataaatgaaggaaagatacaatgtttttcagacaagcaaatgctgagagaatttgacactaccaccccagcactataagaactgttaaaaggagctctaaatcttgaaataaatccttgaaatacaccaaaatagaatctccttaaagcataaatctcacaggacctataaaacaaaaacacaatgaaaaccaaggtatttgggcaaaaaatagcacaatgaatagaatagtacgtcacatctcaatactaatgttgaatataaatggcctaaatgctccacttaaaggatgcagaatggcagaatagatacaaattcactaaccaagtatcttctttcttcaagagactcacctaacacataaggacttacataaatttaaggtaaaggggcggaaaatgttattccatgcaaatggacaccaaaagtgagcaggagtagctattcttacatcagaaaaaaaaaactttaaagcaataacagttaaaaaagacaaagaaagatattatgtactgataaaagtcattatataatcactagtctaacaggaaaatatcacaatcctaaatatgtatgcacttaacactggagctcccaaatttatgaaacaattactactatacctaacaaatgagatagacagcaacacaataatagtgggggacttcagtactccactgacagcactagagaggtcatcaagacagaaagtcaacaaaaaacaatggacttaaactataccctagaacaaattaacttaacagatatttacagaatgttctacttaacaactgcagaacatacagtcttttcatcagcatatggaacattctccaagataaaccatataataggccacaaaacaggtctcaacaaattaaagaaaatcaaaattatatcaaatactttctcagaccacagtggaaaaaatttgaaatcaactccaaaaggaaccctcaaaaccatgcaaatacatgaaaattaaataacctgctcctgaataatcgttggatcaataataaattcaagatcaaaattaaaaaattatttgaactgaacgataatagtgacacaacctctcaaaacctctgggatacagcaaaggcagtactaagagaaaagttcatggcattaaatggctacatgaaaatgtctgaaacagcacaaataaacaatctaaggtcacacctcgaggagctagaggaacaagaacaaactaaaacccaaacccagcagaagaaaagaaataaccaagatcaaagcagaagtaaatgaaattgaaacaaaaaaacacaaaaattaaattaaacaaaagatgttttttgaaaagataaataaaatgggtagaacattagtgaaattaatcaagaatagaagagacaagatccaaataagctgcattagaaaagaaatggaagatattacaaacaataccacaaaaatacaaaacatcattcaagcctactatggacacctctaattgcacaaactaggaaacctaggggagatacataaattcctggaaatatacagccctcctagattaaaccaggaagaaataaaaactctgaacagaccagtagcaagcagcaagattaaaatggtaatttaaaaaatgccacaaaaaaaaaagtccaggaccagatggtttcacagctgaattctatcagacattcaaagaagaatttgcaccagtccttttgacactattccacgagatagagaaagagggaatcctccctaaatcattctataataatgataaatcattatcaccgtaacaccaaaaccaggaaaggacataacagaaaagaaaactacagactaatatccctgatgaacatacatacaagaatcctcaacaaaatactagttaactgaatccaataacatacaaaaaagataatccaccatgatcaagtgggtttcataccagagatggacagatggtttaacatatgcaagtcaataaatatgatacaccacataaacagaattaaaaacaaaaatcacatgaacatcttaatagactcagaaaaagcatttgacaaaatccaacatccctttatgattaaaaccctcagtaaaactggcctagaagggacatatcttaaggtaataaaagccatctatgacaaatccaccgccaacattatattgaacggggaaagttgaaagcattcccctgagaactggaacaagacaaggatgcccacttttaccacttacattcaacatagtactggaagtcctacgcaaagcaatcagacaagagaaagaaagaaagagcatccaaatcagcaaagagggagtcaaactgttgctgttcactgatgatatcatcctattcttataaaaccctaaagacgcatctaaaaagctcctggaactgataaatgaattcagtaaagtttcaaaatacaaaattaatgtacacaaatcagtagtcctgctatacaccaacagcgaccaagctgagaatcaaatcaagaacacaacctctttaacaacagctgcagaaaataaaaacaaaaacagaaaacaaaacaaaacaaaaaaccttaagactatacctaatcaaggaggtgaaagacctctacaaggaaagctacaaaacacattgatgaaagaaatcatagacaacacaaacaaattaaaatgcatcccatgctcatggatgggtagaatcaatattgtgaaaatgatcatgctgccaaaagcaatctacaaattcaatgcaattccaatcaaaataccacgatcattcttcacagaactagaaaaaataatcctaaaatttatatggaaccaaaaaagagctcatgtagccaatgcaaaactaagcaaaaagaacaaatctggaggcatcacattacctgacttcaaaccatactgtaaggccatagtcaccaaagcagcattgtactggtactaaaaataggcacacaaaccaatggaacagaatagagaaccagaaataaagccagatacttaacagccaacttatctttaacaatacaaacaaaaacaaagtcggggaaaggacagcttatttaacaaatggtgctgggataattggctagccgcatgtaggagaatgaaactggatcctcatctttcaccttatacaacaatcaactcaacatggatcaaaggctgaaatctgaaacctaaaaccataaaaattctagaagataacattggaaaaacccttctagacattggcttaggcaaagacttcatgaacaagaacccaaaggcaaatgcaacaaaaacaaagataaatagatgggacttaattaaactaaaaagcttctgcacaagaaaagaaataatcagcaaagtaaacagataacccacagactgggagataatcttcacaaactatggatctgagaaaggactaatatacagaatatacaaggaactcaaacaaatcagcaagaacaaaccaaacaatcccatgaaaaggtggtttaacatatgttttcactcataagtgagagctgaacaatgagaacacatggacacagggaggggaacaacacacaccagtgcctcttagggggtgggaggcaaggggaggaaacttagaggatgggtcaataggtgcggcaaagcaccacggcacatgtacacctgtgtaacaaacctgcatgttctgcacaagtatcctggaacttaaagtaaaataaaatgaaacataaaacaagaaaagaaagaaaagggttaagaacatgaatagacaattataagaagatacacaaatggccaacaaacatatgaaagaatggtcaacttcactaatgagcagggaaatgcaaatcaaaaccacaatgtgataccaccttactcctgcaagaatggccataatcaaaaaagcaaaaaataatagatgttggcatggatgtagtgaaaagggaatacttttacactgttggtgggaatgtaaactagtatagccgctatggaaaacagcatggagattccctgaagaactaaaagtagatctaccatttgatccagcaatctcaatactgggtatctactcagagaaaaagaagtcatcatacgaaaaagatacttgcacacgcatgtttatagcagcacaatttgcaactgcaaaaacatggaaccatcccaaatgcgatcaatgagtggataaagaaaatgtagtatgtgtatgtgtgtgtgtgtgtgtatatatatatatatatatacaccatggaatcatactcagtcataaaaaggaacaaaataatggcattcgcagcaacctggatggaattggagatcaatattctaagtgaagtaactcaggaataaaaacaacatcgtatgtcctcactcacaagtgggagctaagctatgaggatgcaaaggtgtaagaatgatacaaaggactttggggacttggggaaaggctgggaggtggggcgagggataaaagacgacatattgggtacagtgcacactgttcgggtcacgggtgcatgataatctcacgataatctcagaaatcaccatcgctgtaacctaacatcaacttttccccaaaaacctgttgaaatttaaaaaatacaattaagtggaaatggtttctatatggtaaaatgccgtgtaagtctttgtttgtataacatttcttttccaagtgttttcgattttaaacaacccatacttagaataatacttgatttaactaactatagttgtggaatatattgtgtttggtctttggttagctatggtaactaaaattcattaagtgctaacccgtttatcaaccattttgctaagaataatctcatttaattcttctaacaatgctatgatgaaggtaaaatcattttaccaatgagagaaccgaagtatacatagggatatgagatggtttttaaactgccagtatactacattattacatgtatatagatagacaatggtggagcttaatgtatgagcacatgctgtgctgtgtatatgtatgtgtgtgcatacgtattatacatacagaaatacataaatatctacaacagggaaacctgcttatcagcaaagtatgctgctacagacatataaggtatacataactaaatataaatttggagtagttaattttggaaatcatctacgatgtgtgaaacgccatgttcaatgctctaaaccagtgttgccttgtagaagtttaacatgagccgtatatgtcatgtaaacttttctgatagccacattaaaagagtaataaaacaggtgaagttaatttaataacaatactagctatatcaaatgatttcaatccctatttcccttacaaacacaagaaaaaataattgatagaaaaattaaatcactattttatattacaaaatcaaggctaacttttcagttttaaaagtttctgcttttgatattgatgggctgctgtgggcagtctacacttatagatcactagccttgtgatggagggctctcatttctgagacagctgattgtattttttgtgcaatccttgatgaaaaaataatggatgttttttcagtttttttctgaactatatttgtaaccaacccatgactgtatcctctctaggtatatgttctatcccactaaattccaaagcaaagtgattattaattatttaaattccacaaatatgtattgatgttttcttctatgctaagtacagatataattctgaaatagctttttcactggtggagctaatagtctatactaaaggaaagataaataaatatataataaaatgcagtaagtgatttgtttctaagatatcacacagaaatacagtataagagcacttttctcctgtacctttacttctttcaaacctactacatgagatagtaagacacagttgcttagagaataaagaaaactgtggccattgcctgaaaggagtgaagtttgatgctttggtgaatgagaatttgataaatatttagaatcttctgtacacttcttatctgaggatgttcttagtttaaaaaacatttaaaactcaaggtaatgcatgcagtgtgaaattatcaaattttgttttattatcaacttttaaacttattattgaatagatggatattagaacattttttaaaatgtagtaagcatttggttagttttgctagccaccgttcaagcactgtttctacttggagagaatgcttcattgtgcgggggttggaagtcaattgtatattccttctccatactccggggcagtcagggcttggacatatgacctatgctcagccaaggtagagtccagtggctccatagagggtgtttagttggggtggcaccaatggtggcatcctaactagactgttcctaggttatgacattggctcttttcttgactgccatgtctcttttgcttcttgtcattttctgagccattcttttcattttctgagctattttccagcattcctgttgattctgtgaactactaatagtctactaaataatttgattttgaaatcaattagccaaagtcagttttatgcatttacaatcaaggatttaacttctatggtgcttggcaccagaaagtcaatggtctcaaaaccccagggagagaagaaccttatctctggttaacctggaattgcaggcagtgaaaaatccagttaatgtccggtgagtttctggtagcttatggcatgcaatgacaaaacaactaattaccacttgtggttaccaataatgaggtttcaatgaaaggtaaatctttgaggcattgcattgatataatactagagaaaaattaaggtcatacaatttccaggatgccagaacgggtgtttgcttctaatggaaataagtaaaaatagagagggcacaggttaaagttcaaaatttttgactcaaggtataaaacttaggaactttccatcattacactaaaataatttattttctgctgcagctacagtgttgaaaatcaaatgcaaaagattgaaaatgcagattgtcaaatgcctttataggagttcacagaaatgccaggtcttccatgtgaaagcgattttgattaagaagggataaaagaatatgcatagttatattggatgatatcaaaagatacaatgaccttgatgtactttgtaccctaactctcactagcttcctttgccagctgaagctatgccatcttttatgtctgatgaggcagtttcatctgatttgaagatgatgaagaaaagttctttgcaaggtaagtcagttcttctgaagacttgcctgtacctcaatgtctgcacacatcctactagaattggggaatggaatatacatgtaagccagattcaaagctttaagcctaagaggaggagatttcaccacattcaaagttaaaacctaaaaagggaagatttcaccccaaagaaataaaaagaactggacaattattttaacaaaactttgggagatatgtgtgagaagatattctgaagtaccaagaaaggaagagcactacattagactgaatttaataatcaattcaatcaaagtgttttcttggccaaatggctaaaatctggattaaaacatggcccatgctaaagtttagatgcccaaaattccttggcatgatgtataaggaaataacccaaaggtaatgagcaatagaattgattgtgatcgactcacctatcctaaccatgtttgttaagagggttcagaagatatcctcttcaccaaggccttgataaatatattggtgagaggggtgttacgttctctgaaaagttctgcaacgttttggatgttgaagggggtcctgcaattgaaaatgagttccctaatgtcaatggggtggaaagatcctagagtagcagaagtcacataagaatattcaacaatcagaaaaaaagtggacgtggctactatgataggtaatcagaagggccttgcccttggggattgttggtagcgtaagagtacataggactgatggtgaccaaatcttgtgatgcctaagactcaggtaggtcctgagaatggaattccaaaatctaaatcagttcacaggatcagagctcttataataaatatagacttaaggaaggatgcatcagtaccataataagtacatactgtgaatctttattttaatcttcctcaaagaaacctatggtcttttaccaaatgattatgcactagggaatgggaaatacctaaagttttcagagcctattgcatgctggctccaagctaacaataattcctaggcacccaaacgatgactgtactccatggataacagcaggatttagggcaatcaggagataaatggaattgtgacccatcccccttcatgatgggattactgttatctcagctatattctgctattgtttttcaggttgcttattgaatattactgggaaaacaggaaaattaggaggaatgttctggagtgatttatctttttcatcaggggtgagtagaatttctgctatgctgtgggatctggaagtcatgtggatgaaagtcaagtgatctcttttggtcccctttcataccaccatgagtctagtcaaagctgatagcgggttaatacagccttataaattgtggatagctgaggattaagcatccttaggaatacaaatgtgtatttccaatgatacccatcaggtagcactgataagcaccggtgctaccatattacaataagtggagatcctgtacttggaggaatttagtaatttatcagactatggattgcctacttttggagaggagtagttatattttgggttgtaaaagggatatttgagtagggtggtaactcttttgagggaaaggtaagaataggaggaagggaacatctggctaatgggaaacatatatctatatgggaatagatctgtgattttttttctattaattttctaaaatttatttcttttcgtgggtatctgcaatgtgtggaagttactggaaagcagaggtcctttccccactaaagaaggccttaagagacaaatattttctttctatacttcttggcaatgagagcattggcatgtgatcaatgcttggttgttccttcgggacagtgcatcttgaggaagtgaccaagggacacatgcaatagttttatgcttcttgcctcactaacatccatgtgtgccaaagatagatggagtctttccaggcactaactacagagaataaaactatgatctcctgggaggtgtcaggagggtagtagtcatctggccataggagatccagcaatttctttttcatatagacttccattcctcctatcctcagccctcagactttcccctttttctttttactaaatctgatgcctacaggcctctctgggatttcttcagggtgaatcaactttattctcctcaggatcccaaagtggggataactgcacttagaattacagtgctgtcactcagctacctcagtaatctctctcctacacttctcatcttccaaaacttggttgaaatgtttcatctactgagatctcccaaatggtttatcttttttgacttgataaacatttcatttaaggaaattttggaagaacttcaggaggcagaggagaaaaatacatattggcaacatatcaagtttaacattgcaatcttcacaaactatcctctttcaatggttaggataagcatggcaggataattgtattgttaaaacatgtccagaagttaactgtgaataatatcactgtgctctaaagcatagggccacatcattattgaaagttgcactggtcatgatggtatagcagctcagctgaacttcctttacttttattctttcttttttttttttccagtggaagatgtcaggatgtcaggatcttccactaaatggggcaacttttgcatcagagtttgattgactactgttaatgtctgtctcaattttgatttctaattcagacaatattacaagaaaacccagtttagggacatgccaaaagtttcataggaaaaaattatttaattgagtttttatgtttgccaaaacccactcagttaaaatactttgcagacatttttttttctagtaaaattaaaagtatttaacgttcttccatatgtttcaggttgaaagttgatgtactaaccctttctcttcagcctctctaaaaagtaaataacctcaaaaattgaactggatgtaaaagtcatatattttcattctaagattgatacttaaggtcgtttccaaataccactactctggctgaatttatggccttttgatgccccagactgtttccttttgaggactctgaccaagagtctgatctttctatagttggcctgtgagatttgaaagggaaaagccttcagtaaaacatagagatggtgcttgtagtcaagggatacgaccttaggcagaaagaagggggaaaaaaagaccatgtcagtttctacttccaagaaaagctggttgctgttttgataacagtaatgtccctttagttcaaagttaccagctatcaaaacaagttgcagtccatagcagactaactcctttcccttacagagaagcagattctagtgtaactgactccaaataaaaatatatttacgataaaactaggcccatggatagcaagcagaaatcagaaaaaaactaaacttctgaaatgttcgggaaaaaaaatatcatatgctgtttatatccctacaactaagatatcattagaaaaattgtgttagaaggaaataaaattctaaaagacgacacatcaaggagacagggtaatagaaattaagtatctattaaagtaaaatacagaatcactccatcacatgtgttaactgttcagcaaagcagttctgctctgcagttggtatgaggtttgagcaggaagtattattgtctggcgtcagagccagggcaggatccagcttgaacctccaagtcatttcacaaggaaatatgaaattgcagaacagtgtgggtgggcaatggacatgacctgactttcatttattaaataaacacagacttgagtagttgtacttctgagaacattagcagtggcattgccaaggtatagcacttggggaagagggagttttgtcccttcataaatctccatgagcaaccccctctaagtcatccctcataaatttacaatctaagtaatctaagtaaaatcaagtgtgcttgctctgtaatgtagcttccaggcaaattaattagcgttcacttccaaaaaccttctcactcctaagtcctttctatagcgaaattcaggagctgccagtgttagtccaactcccaagattatgtgcaatgttggttcttgcacgaaccagagcacgaggggcctccttggtctccagttctcttgtatcattgtttcatttgctggcaacgagagcaggtaaagaaaaccatagtgtttgtgtagtataaaagatgacttcttaaagatgtgcagacagcaaaatccatgcttaaccaattgtaaaaataagaaaacctgaaaacaattactaatctatttatacatgtaaaaactggaaaatgaattcttagtatatggactggacagctctcagaaaattttttttcacaagcttcttggcggggaagggcatattctgcttctaggcagaaatgaagtcgttggggaggatttgcaagtgcgtgaagtggatgcacacgggtgaggcgtgcccattttaggtcaaatgcacttttctaaaatgtattggttaagaaataaaaagagtaccacagaatttcatcacatcccactattgcattttctaattatggtgtttgtcaatgtgactagtgaaaattcaatatttataaaataactacattctaagcctgtgatgcacagtcagtgtttgaatcagagaatttgtgagttaaaattccctcccatgtagatatctgtcgtcacctgaaagctcttaccatctgatctaaatatgtgaggcactgctgggtgctatattgttacattgagtgtttgaggttggaaataattttaaaaccgattgagtctaatggccacatctgcccaggagaggctgaaagtcttcttcagaatacacccatgctgacagagtgatagccactgttataaatacaaagtctgtgaaataaaaataaaatacatacaagcaattaggatagtatcgatatggtagagtctgaaaggtatcaagaaagctacaaagtcagacaggttaagcaaccagaattcattttcttgtttagtcactcaaaatattctttttctagccacaatgttgcaaccagttttatggatttgtgccctgatagtatgcaactctttgtagtctttggactttttttttaactgcaactggggctattgggctattttcataaactgtcacttaactgggcaaaattccagtccagatgctcctggagtgtttttatgtatgagacattgtctgcttattaaggcttgtctgtaatttcagttaaactgttgagtggacattgttgcttacagaagttagaagataccagagaaagaatggacaatttttgtgagaaacaagcaattctctgatgtttgagataatattaaataaatcaaccggagatgatgatggattaactaattaagggatccacgtagtctttacaaaggcacccaggaggtgcttataatatccttgaggatggatgtctttatgatgcaaacagtgaaaagaactctccttggaagaagacaagatgaaagaactttgtctaagttccaaatggaaatggaactcccccattaaaagttaaaaaaagtaaagaggaagacctagaggaagttcttcaatagagagtcttcggctttctctatctgtgagccattttgctccagggaatatgtttcctcataaattttatgaagagaccccgtgatctggcatcttgagttggcatataattgaacccactcacaggatcttaatatcctctgccaaaggagtcatcatctgaatgggaaaacctttgcaaaattttcccttcatcttacaagaatgactaattttagttgtatcacaaggaagcattttgttccaaacacagttcctagaaatagcggggcattccagtccaacagatgcaaaccttcctcatgagaaccaaaccagcatgcttgggcaacttgtcaatgaagccaaattccctgctttcaagaagattggaagaagatggggcttctaaaagaagagatagttcccacaactctgtgtgggttatctggattgtagaatattgacagcaaaatttaaatcccaggaggtctcttcctcatctctcttggaccccctcctttgttactcttctcactcgttaaatgaaagcatatttcatcatgaagctaaacaaaacttagttgaacatttaaatttattatataattgtgacaaagtaaaatataatgtataaattacacagttatgtatatgcaatgtgttagtaaattctgaaaatgtaaaataaaattttaaaattaaactttaaaataaaaattttaaattagaatttaaatttaaaaaaaatttaaatattttaaaattaaaattaaaaatttaaataaaattttaaaatctaaatttaaattttaaaagtgcatggcatattgggaacttcactgaactgtaagatagaaaatgagtcccgcttatggcttttctagtaactaatttagattagtagcttcatctttgtatttagtcatccgtataatgatagaatggacctaattaatctgtaacttatttgtagacctaaaattctttgattctgaatataacatgttcctctgccttgtatcagaaataatcatcaatatcagatggtgtttgctaagtgttgagtgagctaattagacaagggaaaagaggtcagttccagacagcatggcaagatagtttcagggaactactgggacttgagaagtgaacaggaatgtagtaagtgaattgcagagcactcaaggcattaggatgtggcataagttaatgtatggaggaagtaaactccagatgtgttgagcatcaggaagtagattaactggcatcatggagaattaagacaggctagcatgaagttagagaccaaattatggagagtattcagtgcctggatattcagaatttatgctaacaaatagacaacatcagacctttttttttgattgggggaggagttgggtaaatgggggaattacatgggcataagtttttgaaaaagaggaaaatgttactccttttcattatctatctgtttcagaattttttttcaaaagcatggacagctaagagttgatttcttcattggggcaatatcttggaatctcttagatttctatattagctcaaattttcttattttattgcttaacccaatttatctgattaattagaagttcattagggaattttttgtgtgtgtcacacattacttagcagttattaatttattcctcaagtatttcatgtgtgctgtgcttatggggttgggctgagttctggcaataagacagacacattcttcactttctgaagcttctagtctgtccatttacttttttgagtgagtgatatttcagaacttgtatttttgtatggattttgcatattttattggcagtggtaaataatgataatttttaaaattggcagtggtaaataatgataatttttaaaatttctgcaatatgcatctagtttaacagttatcagaaattcttgtttcctctgaggaatagtttgcagccaccccattccatatcatttgtgttaccaaatcctctatgttcataatgataaattccaagtatgcccatctaagtagcgatttttaaacttaaaccatttgatttgcattattcttcctggaataagcagatttgaactttagaaaatcctctggttcctttgggggaaagaaggagtaagcaggcataacagaggaaataaaataatcagtgggtcagggatgttcagtggagaaagtgaaaatggatccaccaattttgattatattttcaagactcataatttaccctcaggaaagttaaaaatgctttattagtccttttgtgatctcatttctcttgcaaatttcattttcaactaatttcccttgtataaaatgtgaggcaacttggggattttgcaatgtgatgtgattgtgcttagggatggtctgggtaccacgtttttaagtagaccgtaagagaagggtgacacttgtcttaatttagagatttttaacattttaaggtacttaaaaaccattataaaatttagtatggcgtttatagcagagtaatgtggtggaaactttttgcactgagagtccctgaactatataagtattcacaattccaggcctagaagtcgttatgaaatgaagttttacatagtggagactatcctgggttttaaaggatactttggaatctatctacttatggggttcatacaaagtcctgggagatgatccagcatatctgtaatcagtgcttttaaccagatttcatttacttaggagatttgtttactttatctgattatgagggaactgtatgagtcacaattcaaattaccaataatatcagacagttagattgagcatagctgggtcaagttattgttagtgctgggtgactctctgatgtgagcaaactgtgccccacgttttgactcaacctgctccgtacctctatgctgtcatggactgccatcatggacaacactatgccttgacagggctcagtagtggtccctacttttgacatttttctcctttctcttcttcaatacaagtctatcacttttgtgaactatgcattgttcattatccaagtccactggaaaactgaaacatgaacacaaactttgcctcctctggaagctttccctggcccactagctaggtcatattctagctgtcacacattctcctggctctctgtgcatctgcactgcccttttcccaggtataattagatattcatgtaagtacttctttaatgtacattttcccactgtactgtatgctctaagaatgaagggacactatattgtttactgttctatacccattccctaactcaatgccttgtgtatgtaggaggatcttaatcattttactgaatgaatgaatagaatttcagctagattttatataatagtaggcactccatacatgttgagttgaatactgcctcaattccatgtataagaccttttctcaaatgggattttgtggaacagtggttggaatttcagtcacagtgacagttccatgggagatataatgcctgctcggcatttgattagagctgttcctagtttccaataacaatacaatgccttcctcccaaatgtagtatccagtcaatgagagctcatgggatttgctttattccaaaccatgttaatttccctttacatttgtacatttgctaacctgatgtagtaatggctggatgttatatgaaattaaaaggattaaataaatctccttgcttcaaattcagaatgcttttggttaaattaaagggaaaattataaccgcagatgtaagccagtttgggtgtggagcaaccatgtgatggaaatagactgaactcctgtggatgcttcctgggatggtgctgaatgcactgcaacatggctgcggctggaagaagcagatgggaggcttctggagagttccttccatgcctcaccgtttgccatattggttagtcctccaccctgagaaaaagaagatggtggcatttaaggttatactctgcaaccagatcacatgaattcagagctcacatctatcttttgttatttgggtttttctgggcaagttacttaaactctctgtgcctcattctctttaccttcaaaaccagaatagtggtaatacccactgtgtagagttattgtgaagattaaattaaatttacatgtaaacacatgtaaagtatgtagaagagtttgctagggtaaatgcttaggaggtattatttttattatgactagatagagcatggaacttgagcaatggtgaaggctgacactaggcaaatgaaataagcctggttttcaaatgcccatcattctggctaaagaaacttaaaaatgggaggaaactcagcttaatatatgtctctcaactacttacatgaaatcataacatttggaatatcttatatttagttttaatatctctcttgagtaggcaggggaagtattgatatgtgtcctcagcagaccagggaattaaagatagggaagttaaatgttttgtccaagatcaaatagcctataagcagtggatcagggattagaattcagttcacttgaaattgtagtccaggacttttgtattacaacttggctactgctcaaaggttggcctcagattcaagactctttagctttttctgccttttttttttttttataaatctattcaccttgatcattcaaatgtacttaagactacccattgtgtggatagcactattgattgagataatgttctatatgacattgatttttttctgtccatatttaataaatagttactaagtttggggcagtagggatgtagaaataaaaaagaccttgttcttgacctcaaagaacttgtgttacagcggggaatgcagataggaaatgaaataaaatacagcatgatgtgtgttgataataaaggaaagcacatacgccaagaggatagagtgtagtatacaggcaagaacccagctaggaaggcagaggaggccgtggttaaagaaagacatctgagctgagtccatgttgaggttagatgttagtcaatgttaatactaaagagctcacatgaatggacacttttttatatgggaggcactgttctaagtcctgtgcatgtgttaataagtaacaaagaaatacagcactattaaaatggtgttataatttgaaatgcaaagcttcaaaaatatatcttgaatttgttcactctctcaatcttcagtgtaatcatcacctcttttgaacaatttatgtggccccttccactcttatccaagtctaagccacttcctacagagcagccagaattcatttcttaaatgacaaaatggatgtaactctcctacttgaagccttcactgactcttattttattcaaaatccgcacctttttttcatgacctataagcacttacattatatagcctctgacctgtttgcttatcttcagttttttttcatttctttccttttcatttgtgattccttaattttttacttctcccatctcttctctcatctcctactgatgccatttcacaagtcactgtagacagtgcatagaacactgataccataggatgctaatatatgatttaaaaaaatggattcatggttagataggtttggaaaatatacagtcaaatgaggacagatttttttggtttactttgcataacgttacctatctaaatttgcattataaattttgcattattctctaacttactcattaacaaaaaaacaaaatttaagatgattcttatatgaacacactttcagaagatactttgggaaatgtcccaccctaaagaaaaaccatattaaagagatcaatcttaagttggattcagaaggtcagcaaatgtattaccccaaaaatcttatatctgggagaaaagatggggggaacagagttaagaaaagttcatgaaatcctaagagagtctcctaagagactctctcttaggagattccgcaagtggaataccttgtgtattcaacaactagggtttctatcatgttctcaaattaggttccaaggattgaaattgagtcattcttttgagttaattaattccaatcagggtttattaaggatctactaggatgagtctttgactggaaagcttccttggcagagagcaccacgaggatgagagaattgttcctttcctgttttccaatcagatagggtggcactgtattgatatgagcttgggtggtccttaacacatttccatgaatcagaaattatatttgccaaatgctaatctgttgtaaaattaatagcaacatatgtgtgtgatgagtatcatttcatgggttttatctgtttacaaaagacggggaaaggaaattataaaaccatatagcataagttcataaagtaaatgaaagttatatagatttagtcagtgtatccaactctatattaaatgattttagaagactgagagaacacttccagagggctacaatggtttaatgctagtgtggttttgttctgtttttgtgttttactattctttgttaaactttttgcaattgtgtgtgctagaatttcagggtgtgaggagtaggttggttatcctagaataatttctcagtaatgaaagccttctttgggagacctcctttttccttctttttttttttttttttttgtttttttgagacagagtctcactccacccaggctggagtgcagtggtgcaatctcggctcgctgcaacctctccctcctgggttcaagcaattctcctgcctcagcctcctgagtagctgggattacaggcgctgctgccatgcccagctaattttcatattttttggtagagatggggtcaaactcctgacctcaagtgatccacccgccttggcctcccaaagtgctgggattacaggcgtgagccacagtgcccggtcctactttttccttttctattgtttttttattgctaccaaacacatctttgccaggcataaaacaataaatatggattttaaaaagggatgaacatttttgaaaacatatattcaaagagaatatattcttagaatatttctattactattagtaaggaaagaatatgaccttcacaatgaaacatggatgaactgtgtgtgtatgaaaaaaactgatgactaaaactgataactaaaagttaaaggcctgcagctacttaaaagacaatcctagcacaagttacgagtacttttgacttgcaggattcataaaataactaaaggaagacattgattagattggcaacagaatcctaggaaatttggttgagttcatgctgcctggatatacaggcatagaacagggacaaaagtaccttctgcctaattgtccatggcgattcacaattcagaattaactttacacaaaaaagatataaacctttatgttgccattgtgatcttaccatgaactcaaaggtgtttgactagaaaaatcccattctgtttgtgacttgtgaactgaatacgttttggacatttaaatggacatcttggtcattgggtttctctcccatgcacagacaaatagattaaaaaaaaattcagagaaagaaagacctgtacttatttgtgtttgctcaatctcttactttacaaatggagggtgtaacttgtcccaggcaaggatattgcttgccaggaacaaatagagccccataaaagcaatttgcaaaaaagtaatgtgttggtccagggaggcaatctttatacttgccaagaaaattatgggaaggattgtaagtaacaattaaagcctctgggcctcatctgtgaaatcatgtcatctacttcttccactaagtttctgtggggttcaaattagaaaatgtatgcaaaattaatttttcaactctaaataatttctaaatgctgctgtcttagcctacgtccctccagaaatagaccctgaatgaaagaatcaaatgcaaatggtcgtttgcaaagaagatcccagaaagctctggtaggaggacggggaagcaagaccaacagagactaggttattaagttgattactgctatggacaactgggggcccactcccactagtgtacaacacaccttggatgagtgccacctgaacagtgaggaagctggtgtagtctcctctcgcacttatctctgggccatgcagcccagagaaatctctaacgtagggagaaatgggtgcttgtagtaggcagttctgagggttcccagaatggtgaagagtatcccttgcatctgctacaattggttaacatcatgaaacagaagttggcttgaaagcaagctttaatatagctctagggtatgtctacagctgggccttttatagaatattattccagtgtaaagaatgaatccagggccggtcacagtggctcatgcctgtaattccagcactttgggaggctgaggtgggtgaatcacaaggtcaggagtttgagatcagcctgaccaacatggtgaaatccatctctactgaaaatacaaaaattagctgggtgtggtggtgcgcacctgtaatcccagctactcaggaggctgaggcaggagaattgcttgaacctgggaggtggaggttgcagtgagccaagatcatgccactgtactccagcccaggcaacagaacaagactctgtctcaaaaaaaaagagaatgaatccatatttggggtgaatttagatgattattttatgatgggtaaatcattgtgttgtgcctctgtacgtggatatgtgcatgcatgccttatcttgtaagaacttattttggattattttattaggttggtgcaaatgtaattgcagtttttgccactgctttttttatatatatactggctatgaatattatttattctattactatttatatacaggtgaaagaaaataactttctcaagcatacacattctttatttttttaatttaatttaagttttaaaattgtactttaagttccaggatacatgttcaggtttgttacatttggtatacatgtgccatggtgttctgctgcacctatcaacccgtcatctaggctttaattcccacatgctttaggtatttgtcctaatgctctccctcccctcacccccgaccccctgaaagacccttccttgttgttccactccctgtgtccatgtgttcttattgttcacctcccacttatgagtgagaacatgtggtgtgtggttttctgttcctgtgttagctcgctgaggatgatggtttccagcttcatccatgtccctgcaaaggacatgaactcattcttttttatggctgcatagtattccatggtatatatgtaccacattttctttatccagtctctcattgatgggcatttgggttggttccatgtctttgctattgtaaacagtgcttttgccattactttaaatggcaaaaatcacaattaagtttgcatcaacctaatatttgagagataattaaaagtaatgctagcccggtgttgtggctcttgcccgtaatcccagcattttgggaggttgaggtgggaggatcccataatgccaggaattcaagaccagcctgggcaagatggcaaaacctcatgtctacaaaaaaattaaaaaaatatagtaaggcatcgtggtgtctgctattcaggaggctggggcaggaggattgcctgagcccaggagttcaaggtgggaatgagctacaatcacaccactgcactctagtctgggtggcagagtgagaccctgtctcaaaaaaagaaaaaaaaaaaagtaatgctaaactattttattttatttaaggtgattattcttaaattacaaaaataaataaaaatacactgcatgccaatgacattcatgattatttttacagtttgataatatataaaagtgtcttataaatatatcatcttaaaatgttttctgcttcttagtatggttttatattataaacatgtttaaggtaaacatttttgttaagtgtagcaatatatgttattggtacaatgttacgttgattactgtattttaaactatattgcatattactacaacaggttttgaatttattggaattgttggggcaatggagacatttaactttaaaactatcttttaatatgaacatttttataatgtgtcagcatgaactcaattaaaaatctatgatgacacgaatttaaggaaacatattagtaaggacacagattttggtaagaatggctcaaaagagcagtttagaccagatgacaggggccttttcttttatattctcatctcaatgtaagcagcccagggctcatatggcagctgtgtgtgtcgggggtcaggctcttatgtcttgttgctcctccaatctataggcagttttcctcacctgtatggtttgagatggctcaccactttgtttttgtccagccagtgagtaggaggaaagaaaaggagagggcatacttcttccttttaaaggaataaaccagaagttgcatgtatcagccgtactcacaaactgatgtgcagaacttagtccctgaggtcacacctaggaacaaaggaagctgggaaattgtgttagtcagtttgggctgctataacaaagtaccacagacatagttctggaggctgcaagtccaagatcagggtgtcagcaaggatgggtaatggtgaggactgtcttctgggttgcgactgtcaacttcttgttgtatccttacatggtggaagaagtgatggagctctctgggatcactttaattagggaactaatcctattcatgagggatccacccttatgatctaattacttctcaaaggccccatctcctaataccatcactctgggggtctgaattttaacgtattaattttggagggacacaaccagcccattgcagaaatgtagtctttcttgctgtgtcaggagtttggctaaaaattaggaggtttattatgatgagaaaattgacaactagaatttgtcagggtcttcctatgagtcagacaaatatccgtgtacatctttttttttttttttctgtgcacgtagaaaatactcacctattcctcaagagaggagaaacccatccaattgtttcaggttcaaaatcctggaattttgagtgctgctccatcctatctgctatgttcagggtgactctagcaatttatgggacaatgacccacaaattaaaatacaagtcatctgcatcccctccaacacccaccaaatactcaatattaaatggtaatgatgaactgaataactgcagcaaaagggaataatggagattgcatagcgagcactggtctgcagtgattatccaatcttgctggcaggagtgaagcagacttcctgccctagctgtggccttctctccctggtttgctggtgacccggacaggttggaggtctgggtgttgctttaggcattacaattcccataaaagccaaaccgacttctagacttttccttctgactggtatcatgtattagcaagcacagccaattatggcttctagatatcagttttaagtctgaaatcactgatcttttatttatttggctctaggcgccctccacttaatagtaactacttggaggtcatcatggaaaaaaaaatagacttgtgtgttaaagtcatattcttcatctccttttggtctctgggctggttctcctcatctgttagacagccttagcaggaggtgcttgagaaaaacttcacaatgcagtcagaatttctttgaagattgcttcttcagtgctccttcttttttttttttcttttttctttttttttttttttttgagagggagtcttgctctgtcgccaggctggagtgcagtggcatgatctcggctcactgcagcctccgcctcacaggttcaagcagttctccttgcctcaacctcccgagtagctgggactacacgtgtgtgctgccatgcccggctaatttgttttgcatttttaatagagacggggtttcaccatgttggccaggaaggtcttgatctcctgacctcatgatcccccgcctcggcctcccaaagtgttgggattacaggcgtgagccaccacgcccaggcttcagtgccccttcttacattttcttacatttgtgagtgtagaaatcatttttatcattatttcttttaaccctatgatgtttcaaattaccgaactctcagtcaacttagatttctgattcaggccccaacaaagtgagtctctctcagcagatctgtgttctctgcaatatctgcttgtagactggttagatctagcctaggtctatctctcttgtgacactttgttgaagtggtaaatatgtagtcaatgcatagcaagattctaaattttcttaattgtttttttcaactgtaagttttgttaatatagtggtaaatataccatggaatcacaagtgacatatttgtcaaatgatctgccataaatacacaattatctctagcttttcagcttgcattacttgtgccatggttgttttctacctgattgctaatccaatgcttgagtgttcacttttgtagaaatattccacttttggaacaaaatgtatatgttatgctagagccttgccttgaatagtggtatattaatccattttcatactgctataaagagctacctgagcctgggtaatttggggggcggtgtgtgtgtatgtatatatatgtacacatatatatgtttaattgactcacagttccacaggccttttaccatcatggcggaaagcaaggcacatcttacatggtggtaggagagagagagagtgaagagggaactgccaaacacttttaaaccatcagatcttatgagaacttactcaccatcatgagaacagcatggaggaaactgctcccatgatccagtcatctcccacaaggtctctcccttgacatgtgggattacaattcaatatgagattcaggtgaggacacagagccaaaccatatcaagtagagaccaaatataaggtggcttaattaagagaggactctgttgaacagtctagggctgtgcctttgtgctctgctatcccgaagttagtagctcttgcctggatggagtgagatgactgaccctgacacctgtgttccagtggatgggctgggggttgcaggaagggaaaggtagccccagaagatgagcacttcatttctttggccactctttgtcatatgaccactcctagctgcaaggaaagctatataaagtagtttttattctgtgtttcacttatctattgctgcatgacaaatgactccaagacttaatgtgctcaaataagaatgatttatttgctcatgtttttatgagtcaactgggcattttttcagtcccatatggtactgacttggtcaatggtgcagctgcttttacctgccagttgggctagactagaagggacaaaaggcctcttatctgttggaggttttggtgcttttagcttggttctcatccacgaagtttctctctccacatggctttcatctgtcagggactctctatgaggcctctttctccagaagaatagccttcttacagcctgaaagctgcattccaagagggtgaaaggaaagctgccaggcctttgaagggcgaggcctagaactggcatagtgtcatctctgccatgtattttgatcagagcaagtcacaaatcacaactgcagcccagattttaggggagggaattagacttcacttcttaatgggaatagtgacacagacaaacatgaaggggaggaattgtaggagactatctttggagactacctaccatattccagatggttatgcagtgataaaaaccagggcattggacaggcatagtggctcatgcctcaaatcccagcacttcaggaggatgaggcaggaggactgcttgagcccaggagttcaagaaaactctgggcaacatagcaagacccgtttctacaaagttaaaaaattagctggacatgtggtcatgcacctgtagtcctagctacttgggaggatcgcttgatcctgggaggttgaggctgcagtgagccatgatcatgccactgcactccagcctgggcaacagacagagtaaagccctgtcccttccaccccctcaaaaaaatcaaggctctatgtttatgaaagaaagaggaagaatagatagtaggagaaatggagcagcctctgcagaaggctcttgcattttatttaagtaattgttcctaaaatatttctacattttcagaaatcacatattataataggttctatattttaaaaaatctttacaaatacagatttgagaattaatgaaaattagcatcctattgatttccagcttacctgaaagatatttatgactatgtatttttgtagaaatcattcttggcagaatatatcactgactattgttttttaaacctatttctacattatacataataaaatgtctcttctgatataaccttgctttctctttttcatagaaatatttttgggttatttttatatcaacaggatttctttggtatacaagtctctacttttaatgtttatagacttatggactcttgagattgggatggaatttacatttatttcaatatcttaattacgaccataacaacagtggtaattagtatttgttaagaattcatgctggtcaatggttatctcatttaattttcaccagaacttttgtggattaattaccattgttaccttcatattatagtggaaggaagggagatttctgagggttaagcatcttgcccaagattacacggctagtatgtagcaaaggtagaaattcaactctggccaactgaccacgctcttaacttcatgctctggagatctttctctagtctaactcatctgctgagaggttgtccagcttgtgtgttaacacctgatggggaactctcttcttcatcagggtaatgaatttcagctcttgaatttcatgatagaaataaatgaccctgtctctctgcagtcatgcattggttttagccaaactatttgggctcatgaagaaaatgtcttgcctgtgttttccatgacagacctccaaatatttgacaataattatcactctggaatctcacattctttcatcccgcactcaagtcatctcctctctaattctatcagcagattcttatatgatagtcatttcactcttaaccatcattcttcttcaaatacacagcatttatcagtgatgcttttttggcaagccaaattgatggaatccaccaggaatgggccagctggtaaagattacaacacataaacaccttcctccttgtataggctgcctaataggtgatagtgtgtgatggaaagagccaaggctttggagtcagacagacctgaatttggctggtgtttcactatttctactccttcctagctctgtgccttagggaataggcttcatccttatttttttttttccatgaggaaggtagggatgggaaatatccaccttagaaggtgtattaaagatgtaaggtgggcatctggctctatgctcggactccaggaaaatatgctgttttattattgtaatttttagttggccatcttgcacatttctctaagtaaaaggcatatgcagacaagtcaagaatgtgctcagccatttcaggatactgttgctaggagagtttgtttgttgtgaaggtaaagtacacttacagttcttcatgtaagtcaaaactggggtcagatcagcctaatttctgcacaatgttcaggaagactatcgtcttgaatttggctcatgagaaatcttatttctagacaaaaatttgaagcaagatttttctttttgttggaagttcaatagactagcattttgcattcagcatcctgttgattctaagactccccagcatttaaactttcagggatattttatcatccagcaattaaattttgatgaatttgtgttctttacagtctgttctcattcattgttttaattatgcctgtttgtgtttaaatctgttcatgtttaatcaaaaggatggcctcgtttcatttcaaaagttattatcaacctcaaaattgtctaataaactgtgaagtaaaacaaatttgtcatttttcatatttatggaaaagacatgatttagcaatagtattaaaggcagaaactttaaaaaaaaaaccatgtgcagaatatgacatttgcttaatgctttccttctactggcaatgtttttcaggagataacagcacagaccatccagaaggaacttaaagtaatttaaagtgatacctgtgaccctctaagtgcctcctgctatggtatttctgcttctgctttgccagggggattcatacacagaaatctgaattaaatgagagaaattaggcacccattaaatttgcttttcagagagaataacagcaccataaaaagtgctgtcacagaaaaaaatgacatagcctattctgtattgatatgatgatatagattaactcctttgagcatgttgcatttgttattttgacaacttttctaactatgctatagaatttaatttgtaaaaagatgtgaatttcagatactcccaacccccatgctgacatttttggttctaacaggtgaatttctcaatttctgcctttgtgagttcttgccttcaaagtgacttcattattctttattttgattagtcaagctgtcaagatcccaaattaaaacaaaaatggattcagaattctagcatcatgcccaccatctcaacactgtattatggacttttttttttctccaactttacctggcatttgtattgtcctggccttcccaattctgctggtaagcactaaaaccatagctccagatgagaaaatgcatgcctcactgaggtatgcctgtctccccgtgagaatactacctagatcatgatctgagttcttgtgcagataacttttatggcaagtccgtattaaatcccctggtgcaagaacaaaagaagaatagaagaatatagaatggagaagcttgctcaaactccagagagtagggaaaaaaaggtattaaaaagtaacacaataaaacaagcacattggcatatgaatttgcaaacagtaattttcctacctgtggctgcagagctgcactgtcctatcacattcattacatgcccatgggacttttgtcctgtgttcacagttggctgatagcagtataaagaaggatggaggacagactcactcacttagcgtctaggagtcaggtgggctcgttcctgctcttcctttctgtaacctgcaaccttgtatgattctcacagaactggtattgggttcaccacgtataaaatgggagattggtcccatactctttccttgccatgttgacttggaatgaataatggcaacggggtggctacttgacagagttagaacctcttcaactcaggtgcttctcatagatgccaggcactggaattctgatgttgttatatattcctgacctaatggatgctgggctatctcctgctctccttaactccttatgcctcttaaatttacttgatcatcccagggttcccacatttgaatttactaatctggtaaacattttttatgctaaagcccggaaggtcattgaaggttcttctgctgctgtctccgatagccctacactgaacaaagtgcattttaattgctcttctctagataatatacctgcctttgtagtctaatttatcaggaatgctagtttaactcagagtcggggtaagtattactcgctgttatcatgggagacttttggggctgttatgaggagtgggaaaaaaaacagtcagctactgtctaactccacatatagaattaatgatacactttgggaggctgaggcgggcagatcatgaggtcaggagtttgagaccagtctggccaacatggtgaaaccccatctctactaaagatacaaaaaattagccaggtgtggtcgtgggcacctgtaatctcagctactcgggaggctgaggcaggagaaatgcttgaatccgggaggcggaggttgcagtgagccaaaatcgcgccattgcactccagcctgggcgacagggtgagactccatctcaaaagaaaaaaagaattaatcttgatagtcatactcagtgtataaaaccatgaccacagtttgttttgaaaaacagactctaaaagagagtacatgctttccttgtgtgcatcaaaagcttgctcactattgttaaaaccaaaaatagacttggtgtgattaccagttattttattttcattattttgagatctaaaacattgtttctaaatatctacttgtgtaagtaccaagcgattggtaagagttctcaaaaagttccctttcctcagattcttgaaatctctcctttccaagagaggtctaaaaaacatacaggtttaagatttccatctaatagttttaatttaaacatgtctggagtgggaaggtgtcacacaaagtaaatcagattaacttggagtaacttgtgttgttatacagaacagggttgattctcaaaagcatccttgtactaggatggtttagaatgaactgtggagcatgtcttgtcttcagttatggaccagggacaggatatgtgggcgttatatggcatggctttggtggattatatggcatgtgttgagaccttctggatttcatgcaaaatacacttcgtgtagatacagagtcttgttgaggagcaggcacagagatctgccctatgtttatagcactaagtgactgttcatgggctgcccaatatattttagaggtatttggcacaactcatatttttattagtttttggaagaaactggctttccctttgttatctttccaatgccaagtttgaattgaaaatgaacattacatcagcttgtttcttggtcattgggaaaaaatcccgtctgtacagacaaattcaacctgagtaccaagggaagaagagacatatgatgtctgttgaaaattgtcgtatcaagttttacacattttgtttagaatacagtattgtccctatccaaatcttggacacacacacacacttaaattttaagttaaaatctgctctacatacacaagaataaagatttttgtaagcatatccttgtactgtttgcaaaatttaattattctgtgataatcagctaactagtcatgtttatagtgactgaggaaatctcacaaggaaagcactaaagcagggtctggaaggtggatttacatggatcccttattacacctattcccatgattgcacattaactaattttgtattacatatttgtttcagtaaaatataaagaaattattatttaattggctcagagatttaaaaagtactgaataaggttacattcttagtagtgtaagataaccaagaagacgatgttcagatcttctgtgacataaattaccattgttttgctttcccacaacgtgaacattttttaaatgctggtttgagaaccaccatcacaacaaaggatgttaatgtgttaggttttttcttttaatataaaacagacctacttgcatatttttttctagtttagcagttattatgcatctactgacttggttagctactgaaatcaagaatcctttaaaccaagagaaaaggagaaaatactaaaaacaaaacaataaattaaagagctctggggtgtgtttggattattttcttgtcatgattcttgggtgtggtgacacttgttggcttttctatgtggttttattaaggactttgtgtacatttccatgttgttcagcttatggcgtcttgcctttgttgtacccggagttcattgtgcatgtaggatgaactttctcacagtcatgcctatgtaaagtgccaaccaaatggcttggctgcttcttctatatctgctgtacctacatactctcaattacagtactaggcaagagcataggcaatggaaagttgtctttataggattttccttgggatgagttttgtagcagaataaatagcagataaaatagtgcacatcatacttgggcaatgtaattactgtttatttgtgaagataattaaaaaaccaaacatttgctcaaggtttgaaaaacatttgagagtgaattgaggcagtcagttactttctgtccctgaggtaagatcactgagcttaggttaagatacctcacaagctgatttggtcttctttcctcggcttcacttatgtggctatagcttcaggaatctgagattgtcagaataattagttgtgggtttgtttgcttctttgttttctgaaagtaattttagaccagatggctagtcataaatttattcactcattcaagaactagtcatttagcatctatgtgggtcagttctgtgctgaacaattgatatacaatggtgcacgatcttccttgtcttcaaaaaggatgtagtctagtggggaacatagaccactatatacacaattgtaattcagcgtgctaaggattaagtataggggccaggtagtgttaaattgggtgcacctgacctatttgggtatattgagagaggttgcccagaagaaatcatagtaaaactgagacaaatgctagtaattaacaagcaaaagaggtaaaataaaaagaagaaaatacggagtattcaaagcagagggctcacttttgcaaaaagtcagagttagtagttaagattcaaagtctgccatgctgtcctggtgaagttctaataacaaacatacacttccttcccagttttccttattgcatggctcagaatgaactcttatttcatactcattcttactatatagcattgcctttggttatcacaaatagtcaccaggcttttccctgaaagtaaatgggtttcattaggagcagatgtaattctaatctgtagagtctgtaaaacattcaagggattatttggattaaagaactctaagttttaaggggaaaaatattatcattattttaataatactttcccaagtcgcaaacgaataactggctccaacaatcacatcactgtaattgttcacacatttcaggcaggcattttacagccacacaaagaaacttcaacagctaagctcctctgatttgattgctagagagactcaaaatttctgttttagtgccaaaaatcgaatcactagagcaaaagttagacaggaaaggctgaacttgaacaaaagttcagtggttttataaagtgtgctattattgaatctcatcaaatttaagatgtattagttgtaatgtgcactattttatgtaacattaacaataaatacataacacactgccatttaaactatgacatgctatcagctgtaagaccttctcctgtttaatttcagagagattaacatgtgaaatgatgtctatcttagaatctgtgaatcatggctaacaacaataaatatttctatgaagtctaatgggtatttcttctatatgataaaaaaatcaaaatgaaaaatagaaaatcaagtcagacatttgaaggctttgtgtttgagattggaagtgttggaaggaacatgatagaaaatagaaaattagaccttaaaataggcattccagtctcttgagcacattaaaaatccctattacttaagggagatttgctatgcactgaatctgaaaaacagaaggggtaggaaaacataaagatattgtcagcttcctcttacctccatcaaacagaatcatagtgtcattaaattaaattcttttgatcttcagcactttttgaaagatttttgtgctctatggttgtaaatgtatacacataaaactaatagttatggtagagtgactataggaaaagaaataattagtgagaaactttgggaaaatggtggaagaataaccaaaagatagaaaatgtgaataacttttacttatctgttactggctattgagcaatagatgaagatgagctgagtaattgttcaagcctaatatacaacccctgccttttaaagttttgctagatctcctttcagtattactgaaggaatcaagtggcaactgactctaagaagataaggttgtagtcccaaacaaaataaagcaaggctacaatttattcctaaaccacttttccttaccttccactgttaccttttacatttccttaataatttgatactacttttccaggatccagccacatgcccttctgccactgtgacaaaaagctaaattttctctttgctataacaacttaagtgttacaaaccaggttttctcatgagacaaaaggtaaatatttctaatatggaaagagtttctactgttcataagaaaaagaacatagtacgtaaatgcacacagacattgaacatggagttgacagatgaagcaatatgaatttcgaatagtcatatgaaaatatcctagtgatcatcaaagtatattgtatacctataagcagcaagactccagtttttgcctgtaagataagcaaaaagttaagatgattgataatattcaatgttagtgtgtgggtaggagtagatattggcataactgttttggaaggcaacttaatgtttaattttggaatttcaaacttcatattgatcagtaaattcacttttaggattctgcctgtagataaactcacatgagtttacatgaatatatatattgattaactgttgaagcaatttttatgaaaactaaaaagaggggtctgtaatctaaatatttgtttacttaaataatttttattgaaataaaggtgagaatatatacaggatcttgggcggtggccagtggccagaccttctgctcaggtgcctgaaaaggaaaagaaggtctggtgtacaaatatgtgaatggggaaatagaaatggcacacaatgtgggaacttatgactacccattggttcccactggaaagtccccaaagtgtccccaaagaagagacactgatgaaccaagcagacaagatgactcagccagttgacattatccagcctctgtcattgactactccagaactggaatgagagacacatgaatggagttgtcatgatggtagcgataaaggccacatgtgaaccaaacaatatgacttccacttcccaagtctgctctggctgcctctgaaagttagcaacagggaccaacactgagcccaagatatggcactattacttaaggccaaccagatactctgtggaagtcaaatacattgggcctcttctgtcttgcaagggccagcagtttgtcattgcaaggatagaaacttattctgggtatggatttgcctttcctacctatggagcctcaactagcattattacctaggaacttgtggaatgtcggatacacagacatggaattccacgcaggatagcattcaacaagaagccctttttaacagtgaagggggtgcagagtggacctatgaccattgatccactcatcatatgaggtactgcattacctagagacaaccagccttgaagaatgcttaaatagtcttctagactatttaaatgccagcatgcaggaaactctgaatggatggtgtgtctatcattctacaagacatagtgtatttattaagttggagacccctatatgatgctgtaccctcaaaagaaaggtctggaaattcaagggctgagcaggagtgacttcacttataatcacaacaatgacttactgggggtcctgtcttttttgtcactgtaactctgggcatactccacattctattgcctttcagaagcatatgggccaatacagaagaagaataattatagaagtagaaccccataaattagttttctttttgcaaacactcatattacttggaaacttatgttttcagtgtaactgattctgagttcattttagctggcaataagtagttacaatttttttaaagctgaattacatggtttaaagagggaaaggaatgccaaggagactaatacagtaggcccatgagttctgcatctgtagcttcaaccaaccatgaatggaaaacattgaaaattaaaacctaataaagaaaaacactacagcaaaacatagcaaaaattaaaaaatacagtataacagctatttgcgtgacatctacatagtattatgtattataagtaatctagagatgattcaaagtatacaagaggatgtgtgtaggttataagcaaatactacaccattttatagaaagaatttgaacatccatggattttgctctttatggggggtcctggaaccaatccccatggataccaaggtacaactatatttatctagggttggtcatggtagatattatgctgaacatatgttaaaaatgccttttatatccattcatttatttaataagtggggtaaaaaactagggtgctggggattacttattaacaagacagacacattcctatccttacagagcttaccttttattgtaggggtatatattattaacatatacacaataagtaatataatgctcagtaaaaataaagctgggaaaagatgatagccagtgaaaggtagcttggaagaatgctgttattttcaatatagaactctctctgagtagatgaagtttatgtagagacctgaataaggtaaaggactgtgccatgtgactatcaagggaggagggaataggtagaggggacatcagtcacaaagatctaaagaagggaataaacagcccattcaaggatacctaagaaaaccactgatgaatgggcagaagaggcagaaatggggttgaggaggtgggtgaaggctgacttgtaggcttgggtagggagtctggattttattctaaatatgttgggaagcccttagagagctgtgcacataagatggatgttatctggtttaggttttacaaattctactctggttgctgttgtggagaatagaacctaatcagagaccaattaggagacatttatttatttatttatttatttatttatttatttattttattattatactttaagatttagggtacatgtgcacaatgtgcaggttagttacatatgtatacatgtgccatgctggtgcgctgcacccactgactcgtcatctagcattaggtatctctcctaaagctatccctccccgctctccccaccccacaacaggccccagagtgtgatgttccccttcctgtgtccatgtgttctcattattcaattcccacctatgagtgagtatatgcagtgtttggttttttgttcttgtgacagtttactgagaatgatgatttccaatttcatccatgtccctacaaaggacataaattcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggcaaggacttcatgtctaaaacaccaaaagcaatggcaacaaaagccaaaactgacaaatgggatctaattaaactaaagagcttctgcgcagcaaaagaaactaccatcagagtgaacagacaacctacaaaatgggagaaaatttttgcaacctactcatctgacaaagggctaatatccagaatctacaatgaactcaaacaaatttacaaggagacatttagttgcttgagtcctggctgagagataatggtcagtggcttggggttagattttatgttaaggagaaaattctaggcttaaatgtgacctttgtaaacagcaacaaaagcaacttctaggattgttttggcaatatcttaggtctgttaaggtatcagtctgctaaaactgatctaacatatgcacagttttgacactatacacatatgggcattttgtagtatttctataattctcaaatgagtttgtaatcccaccaaaaatgtataaaacacactgtgaggaggctgtaatatccactaaatggtaatgatttctgagatatccaagatcagatttggaatcttctgatatccaagatcagatctggctcaggacaaattgcagggagcatttcaaaacaaagccctgtaggtcattatctccacctcctcctctttcttcccaactgtaggtcaaagcttatgaaacacagtatgatttgggaacatataaagttgcaaaagagataaagggaacccgtgctggcacggtgacacccagagctacaacagcagctctgaggccactgcagagcagccctcgttgttgtgtgccagaaacaggagcccctgctgacccatgcaagaccttcaaaggatgccagatgactgatttactgtggtttcagaggggatccaacagagagcaaaagtttagcatacagctgaaaatcacatcgattttctcagctcactgtagtttattctttccagtggatgtgtttatgtgtttatccctcaaatgaaataccctggagctacatatgtacaatgctgaacatatctgtcagtggcctggacagtaaagaggaccataaagccatttgtatcattattcaaatcacattttgctttttactctgtagtctcaggtcatttattggcctccctctgcccagtttacccaacttgaagtaggtataagatcacaatcaaaagagaacaaacacaggttgttgtgaggatgaaacacaatgtaatgtttataataaatgtgtagccagttcttggccacagacttagaaggtacttgataaatgtttctgttcttccttctctcctgtcctcctttcagctggccattgtaagaggctgttctcagttctgagtaagtcttgttgacaagatggagcctgccccttgaagtttggtcgcttacttgcaggttttatggtctaatagggttttaaaactgaaggggatcttagaaagtatacagtcctcatatctcatttccaaatgaggagacagcagtgcagtgagtgcaggcgatttggccaaagttctgcagatactagaaggacatgtgctccccgggctccatgtatcacacactctttctgttggcaccatattctctcataccctgctgctcagttgtgcttgtgcaacaacaatgtgaggctgcctgaacccaatggtgaagtttgacagaaagaatatatttcctttgcttcatgagattcacaataaagtgagcctatttgttgtgctggccttacacataactttgttgacttattttactaaaagttccgggtgatcctttcaaattctgggaacttaaaattatttggccaggactcaaatgactgatgttgtctctaaattgtgcttgtgaaatcaaaaaaggacattggtagtttagcacatcgcttgtgtttagaatgaggtttataacatctctcttagtgcaacacagaaatttgacacaataggcaatagtcttgctctttagatacaaagttaacttcctgtttaaaataagtagtaagcaaatgctagcataaaaatttaatgatatctttgctataattttaagtaattgaaagtatcctctacttctgtgccctgagacagaagttatgaaaaatgtgtgttagagggaacttaaaatgtatatctaggttcataaacccacaagcagattaaagtttcttgatctgtgaaacatttccagttttagagacacagtccctgagtcccttgactcccaaaatactcctttggtctctttctttttccattgcactctcacatttacttaaaatagacttagtagtacacactcctctactaactgaagacattttctttctttctgaaaatatctatgaatctttatgtggtgggtacataatttttgaaaatactattgtaatgtgatattttacctggtcattttgaaagagccatacaaaatttatctacaacatttctaaaaatattttcttggcagtaaatatggggtagggaaaaaatttgtgcaaagccttgtagcaatttgctaagcaaattagaagtctttgtagatctattacatggggaaactttagctctgagtaaagggagtacatttctcagggaaggccgtgggaattgtgaaatgtgtacttgagtctcagaatggggctgggaaatatttttgtcaagaggacaattgcccaagagtcccatagctgacatttgttctaagtgtgagtgtgtctgcatgacatcagactatctggattcatagcaaagaattccatcagatgtctggacgtttggggttggaaaccactttgctctctgtttgctaaatctgttctcccatccaggggttcctcatttcctataagtggaggctcaggcctgaccactgtcagaggctgcatagggccctccgggaccatttctgagctactgtaggagttttgctcataagggcacttacactgaggcaggagaatagggtctgcagagagggaacctaaggctgtttcacgctgacttcctagaactaaattgaaaggaaaaccctgactttccacgcctaagtaacaaaaggaccagaggctactccctttgcaaatcccccaccttttctgcgcgcagttgagaaattggcagtccgcaacaaatcggactaattgcgggtggaatcttcatttgcatagaagtataactttgtaacttcaccctagcctctgattggttgctttttgcaaccaatcagatgtttgcacaggagtgcgacctctgtaacctcacttcagcctctggttggctgctttctacaaccaatcagactgattgtgggctacaacttcatttacataaagtgagcgtgaagtggccaatgggaaacttatgggaggtattttggcccaggaagattctgtatcctgcccttgagctgctgcttgggcctgttcccacactgtggagtatacttccattttcaataaatccctgctttcgatcttttgttgcttcattctttacttgctttgttgggcgttttgtccaattcttagttcaaaacgccaagaacctggacagcttgcagtcacgaccctctaccagtgacaacacctcctgctatttactattcaccactcatgcttcatacctcaattctgatatcttgtcacactttttggcctaatgtcctgatcattcagggctcaaattcttgtagagagtctaatccttcgttcccttggcctggattcatgagcccacaacctgactgctcagattttgtgctcacattcttaagtctgaatcaatatttgtttgttcactgccataaacaatgaaatcttcagacttttgtttttgtttgttttttcttacatacatagtttttctacttgttgttttggcccttcctgtttagttttctcctattttattcaattctagtgagacagctttacctacacaaagccaacctgctaaacatttgaaaatattttgttgggtatagtgaataaatgaccaagtgaatcttttatctattatctatgtatgtatgtatgtatgtatgtatgtgttatctatgtatgtatatatctgttatgtatgcatgtatgtatgtatctatcatttatgtatgtatgtatgatctatgtatgtatgtatgtatctgttatgtatgtatgtatgtatgtatgtatgtatctatctatctatccatctacctatctatctcatctatcttttatagttttctggcacttgacattcaaggccctcaatcaaccttcttcctacatgtaccgtatttccatttctcttctttccaccaactcctctctggcaagaatactgttcatcaatctcagtgtgcatgatacccttgtttccccaaatgctggctcacaaggcttccaatgcctttcacccaacttatctccataagttttatttctaatattctttcaaggcaaaatgtaattcttcctttttatacaaggattcctgaaattgtaatttcttcatgatctgtcttccaaatacctggtggctcttattctctaaattacttattttactaagtgccacccagtatagttacagctctatatcagaagccattttggtagaaggaactgtcttccctactttgggcttatattatttatctactatgttctcataacagagttggtgctcaatgggctttgttaaaaaatcacattaacagtttttttctttgtatacagagattaatgccacaaaaatggtgaatatttctcaaacctaccaattttcaagataactccactttagactcatgagaaagagggatcattgattgaaagtagcttcctacagtgggcatataatcattaaatttctggaagaaagctaaaaccacacagaaaatcatcttgaggcttacacgcattcagtctgcctctgatctaagaggatgttggccattaggagatgaaaatgttttgagctaggaagaaacaatgtaaaaggccaagtggcctagtttaaagtttctttgtttttctttataataatgaatgcaatagaaaagtgttgaggttataaagtttttaaagttcattaaagggaggggatcaataaattaaaatggcaaacagttgctcttaaacatgtctttatggaaattagagtagtgtgtatttattttgctgttactaataagcaatcgatgttgtgcttgacttcttgagcagatgtaaagtcatcatgagatgtttccttgtttctgtgtggttcttgtgtttaataaaatggtgacttccttttgttggcatcagttctgtaattcagatgatctttttactgctttgtatccatccaagttgtgaaatcaactataagctgctcctttcagcttgccagtgatgtggaattcttaccatatgaacgttccccagggtttttgtaagcctctttaacctctggatgcactctattgacagcttccgagttgtgataagtatctaccttttatttcaacttggagatttcttgaacttataaaattacatttgctttggaacaaatactttagagtgcactgagatggcaggttcatgaattccccagaactttcataggaaatggagaatgcaaaggtcatgtaaatatagttgtagtaatgtcttcactgattgaaaaaaaattaatatcaaacacattttagtttggaaagattgccatcagagtggacagcatagaaggaatacatatgtgggttatcttgtgggatgtggttcaaaataaaactatattttcagatagttgatacttcctaaatcagtatttggatcacatcataaatatttttttaaaaatccaaaaaaactctgtgtgtgcatgttttgtttgtactattctcctagctctggttatatttaccatctatttatctaaaaatgttcagggaggggaatagtatgagatcagcaggttggcagatggctatacactatttctaatgtttatacactattctaacgtctagattttccaccacaattatgcatccatgtattatttatataactaaaataatttaacaaatgcacatagtagtatcattctgaattacatttctgggaaattacaaggaaatttaatgtgagctttgaccatgacttaaaaaattattattatttcctgagattatggattatatttttattctttttcattaatttcattcaacaaaaaattgtttgggctaggcgcagtgggtcacacctgtaatcccagtactttgagaggccgaggcaggtggatcatctgaggtcaggagttcgagaccagcctggccaacatggcaaaaccctgtctctactaaaaatacaaaaattagccaggtgtggtggcatgctcctataatcccagctacttgggaggctgaggcaggagaattgcttgaacccaggaggtggaggttgcagtgagctgagatggcgccacttcactccagcctgggcaacagagtgagacttcatctaaaaaaaaattgtttaacatttgctatgtacaatatgatatgttaggcatcatgggtactaaaataggtaatatatggatcctgcccttgagtagcttatagttcattatgaaaaacagacataaagaatataagtaaaataaaattccacagccactaggatagaaacctaaataaaatacagttattaaataatctaaatagcttattaagtacatgatattgttggaatgagacacagtggagtgccagataccagatgccaagttgaatacatgaccaattcctcttagaaaaatcgtcttattgctttgaacaagtagatagcgtggtctccagctacctggtagttaagtgttgaggtttgattgtaacactcaaatacgttatttccatttattattacaaaaactcttctctctacccctgggttatgatagttccagattaaatatctgcattacagaacgttctcaatattcccagtagttgtattctataaaattgctgtaaatgctgaattagcaaatactaaatcattgctcctagtggaaatactgagttaggctcctgcaaacctttggttatattttatcaatctatcaacacataatcttgtttcatgtgtgtttctgtttaaaggcaactttgttagtatatacatcttacaaataattaatttcatggtctttgaatgatttaaagccaagagctttggaggctatttgtattatacaggtatgtttgccaacatacttgtaaagcaagccaactcagtttcatcagtgttgaaaatgtgctcttccacataactcctttcctgtataacacttagcaggtactttaaaaattttcctgtacagaacttgccttgcctgcatgtttagcatttttcatgccttatcacctattgaaaatgcagagcagttagcactagctaaaaaaggtttgaccttttctaaccctgggaaatgtgactgtaaatttctttggctttcagcttcaaaataactctgtctacttcactttgttgttgttgtttgttgtcatctcatgaatccacaaatttagccccttcacactgattttatacctttataagtactatagatgctaacttagcattttccaaggcagccttacataaaaattggcaaatttctgcttcctttttctggatctaccgtattgtttgttcattaatactgaactcacggccaacagcagtaggactcaagcctaaatgaattttaggtaacatacataatctctgtgtaaggcacgtcacagcctcttgcacttaggaacactaagcactgcagcactaagcgtgggcgccattttaaacagtaaaatcaccaagataaagcacaaaaatgtaaacaatgtggcatgaaatgcaccacaaaaaggacatttgttcacagtatgggctgaaacaataaggcagagcattgccttgttcagcctcagccaggaatgtgcttaacaggcaactcaaactttttgctactctgtgtatacctgtgaatgactatgagagtgctgtgagtatccattttgggattacaaatagattttttaagtaagtgaattcacaaatacagaagctccaaggggtgaggatcactgtacgtaatttagaaaccctgcctcttttagccacctcctgtccccccagttgcagtactaattcccagggctctgaactatgaactaaatacaagatcacaaaagattggtttaagggggagttctacaaggtcatcttacgtggtaactattcctttgtcaagaatgcacttatactttttctaccagaggctttaatgttccacgtagattgatgataagaatacagatgtgatgctcttcacaatagcttacctatgagtagtcaaataatgccattcttatataaacaaacatgttataatctggctaaaattaaacaggttatctacttttttgttcatatttaaaaatagaatctatgaagaattatatctggttagttgttgcttcatctttgttgatctttggataaatgatgcctataattaggtgacaaatgtatctctgagtgaggcaccaaccacattaaaaaaaagagtaagcatttttgcatctcactcattagtagtcattgctgggaactccttttctgatgggaaagttgttccatgtcctttaatctactgtggaaatgttgacatcattgcatgcttccctggaattgccacccattctccttcctccccaaactctaccaagttattagttctctaggtgtctttgctgtggttctttcaattttatagacatcttgttgggatatggggttattattgactgaagatggttgaactcatgacatttaaccaagggagaagagatctgtaaaaggatttgactcagagtttgagctacaatgaagcctatgtcttattctgggaatcccttggatgtcatggtataaaatttggttgtggaaaaaaaatgagacatggtacaaaaggctggacaaggctcagatggagagggaggaagtttcccactaactataactagcagttagtaggaaagcctatagaatgtcaaaaaaacaaacaaaaaaaaccaacaaaaaaacaccaaaaaacaaaaaacaaaaaaacagcaaggaggcttttggacacacggtagaataagcaaatgtgaacagactaaaaaccaccttaaaatattagattaaatataatgattgattttaaagcatagataaaattaaaagacaggaaaatccccaggtgttataagaaaataaacataaagaagtagataagctgtttaatgttagtgaggttatagcatgtttgtttatatgagaataaaattattagactactgaatccccaagtgttataagaagtagtaagaagggaatcaaaatgagaggtcatggaaaactaataccaaggcatttcacatgggtttcagaaaggacatatgacctagttactggagaaatggttacaaacacctataaagaagggaagtgtaatctgagagtctttcataaaacacaaaatctctaaggatttccagacctcatagcttggaagacaatcccaaacaattaagccaagaaaatgtaaacaaacttacgatttatctgggactgtgttggaataaccaaacattctgagaaattaaagctgtagatctgaatcacttgctgatgtaggctctacatttataccacctgggtgggataggtaacatgatctgaaaaatcaaccttacaacccagtcccacatcactgaaattccccagcaaaaccaagccccaaaccattatttcataactcagaccattttggactccaacaggattttataaaccaaggtgatcatgagcccacactaatagattgcaaacctcacaagaaaatcaccatgagcaagagtcagcagacacagtaccagatgaattaatgccacgaaacttaaaatactagaacaatctgaaaactattataagataattatgtttcaaataaattataaaagtaaaagctgtaattaatacaaacatctcaagtgcattgttgtgttaatctacaatgactgtttgcattgagtgcttgcaaataagaaataaatccaaagctgatttttatgcagaagctaagagagaaagttgaggaagtcagatttgtttgggtatgtgatgaatcttcgggtttgattttatgtcaccagtgtctatccaaaaactataatgaaaatctttttttaaatttttttatttttatttttttattttttaaacatttattttttcaatttttagagatggggtctcactatttttatttatttatttatttattattatactttaagttttagggtacatgtgcacaatgtgcaggttagttacatacgtatacatgtgccatgctggtgtgctgcacccactaactcgtcatctagcattaggtatatctcccaatgctatccgtcccccctccccctaccccacaacagtccccagagtgtgatgttccccttcctgtgtccatgtgatctcattgttcaattcccacctatgagtgagaatatgcggtgtttggttttttgtccttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcagtaaaatcttacttcatcaggaaaataaaacaatggggccaggaaatgaaagaaaattcaaaaaagttctaacaagcaaaagtgaagtgagaaggagaactgtgggtaactactatctgtgtctaatagaaatgttttgaaaatacaagatgtggaaactacttttcttcaggaaaagttcaatagtttacgacctcattacaaggtccgggtgtggtggatcattcctgtaatctcagcactgtgagagtctgagaattgcttaaggccaggagttcaagaccagtctgggtaacataggaagagtcctgtctctacaaaaaaaaatgtgaaaaaatgaaaaatagccaggtgtggtcaggagcctgtagtttcagctataggctgaggtgggaggatcccttgagcccagaaagtcgaggctgcagtgagctatgattgttccactgcactccagtctgggtggcagagctagacctcatctcaaaaacaaagcaatgcagaaaagatctgattacaaggaaacagtaataatgataaaaatgaaatattaccactctagaacatattttcataataaatggtaaataagcattgatttattaaatatggctccattaaacttctaccatttgtcattgtttctcatatatttaaatcattatcacatagcatttgatttggagaaacagaatatctttgtgtatgaggcctgatgaatcgatagtagcagaatctccatggcaggcatattattggagatgatagtctttatgtaaacatcactgtgggtttttttttcactgtaaataggcatgcaaaactacataaaacaaagaaaataaaacgcatggtccagggacattgaggggattagggaatatatacctgacactttgttgaatcttatgaaggaaaagcactatgtggatggctacagctattctggcatttcctcatatgggaaaccgtcatcaatttcttgaaaagagccttgcagcaaacatccgtgggtacagagtaagtatagataaaaatagaattcacactgagtaataatcttagttcagccttttgccaggatgaccatgtgccaagcaggcttttaagcaccacacatatcaactcagttagttctcccagcaattctatgaagtcaacactaatattattctcatcctacagatgagaaaagtgaggcactggctttacttgctcaaggtcacacaggtagttagagggggaagagactggctccaaatccatgtgaacaccatgtgatgatgtcttgaggatgttgtaattaagaaagtggtttgattcttgactcttccacagacttgaggtcaatgagatagattctctcaatcactcgcaatgtattagacacgacctttatgtcaaacattgctaggcactgtgcaagatgcaaaaaaatgaaacagttgaaattagcttctggtagaaattgttcaagcatcagagatgtgcatagtctctaattctctcatgtgcctggaataatatatgtttagttcaattaaattcatttcagttcgacttaatgcaactacattgattaaacatctcatatatgaagtacttggcggtaggtatagaatgataaatagtccagccctagacgtcattgagcacaccctcagtgaaggggacagacacaaataagtaaataactccaagcaaaagcaatatgttataagaaagggagaattaaagtgccatgggaatgcaggctgaaagttgtaaaagtaattgtaagaggagaagaagtgtgtgtgtgtgtgtgtgtgtgtgtgtgtgtcaaagagtcgaggagggaggaagagagaatatttacatttggccttgcatgaggtagaatttgctaagcagaaaaaggggtagaggatagagtggagagaagagagagaagatggaggagcttaatttaggatcaaggctgtgaagacaccatcacccaagctaaatagttaaattgtattatgtttgaaatggagagcactggcaggattgaaaaaggtaacagtatgatcaagaaatatctgaagtagccaactctgatattagttgaaagctaaactgaagaaaaaaagagactagcaaaaagagaattattaagtagagttaccatgctctttaaaatttctgttttaccacccaagcccccttatatgaatttgctgtaatcataggaaaaaagctaccaaagaataaattgatttgaggacactgatccatgctaactccattaagagtcacttaatctagttttggatatttctatacatatactctagatgtgaacatctagataattaagattctggtcctatattggtgaaaacaaaatttctcagtgtgtttgtgtacaaatcctggttccatcactaatgagtatgtgacatttgggaagttacttgaactatgtcttaggcttctcatttgttgacctgggaaagcaacgtaactgtttcataagctgttatgaagattaagctgcttaggacaatgttggcacatggtacccattttataagcatttactaaaattatccctaagcataattctataagatcctctaaatttctttcttaccaacaactttgagaaattggaactatatgtgcttaaataaatcaagacaaaacaatgagagactcagaacagtaactcttacatattagaatacatttgctaaaaatatgtaataactccttacataccaaaaaacctaaaaagctgcaagcacatttgtgaatcgtgttattctctgagtaacatattttggcctatcatttctctttacttacctgaccaatgatcaggtagtatcagaagaaaagaacagtcacaagagtgacattcttggttaagaacctgtgtaacatctacctaaagtatgtttcaccaagaaggtagattttgattacattttacttctaatttggaagacaatgtattaggagaaagaaaaacttatctaaactgagacaaatgaattccatttagttctatgtccttttcaatctataatgtatcatcacagtgccttgggaagtagtcaagtcctacaaattcattccccctagaaaattttcctcatgaaatgtgttcttatatagttaccacttgagatgatccaaagtatatgcatacatttcaaatttttcattctcatggtctttttttgctgtttgattccttaattttgttctcattgtcaaagcccacttctgtgattcttaaccaaataagtaaataggaggcaatggtttctgttatgaattttatggcctttgtttttttaaagaaagttagtgttcagaggtactttctcccatgtctctaacgctgaaggattggaatacaagccaaaattcaaaggcagaaactcagtcagaagctggcactttgcctatgacttgatggacctgttaaataatctttgaggtaaaacagattccaactacatcaaacacagtgaaggagtaagttcagaaaatagtgttcttggtctagtaaaagtccaggagtaccagctctgtccttaaataggttgaatacaatgaaagacaggaactttcactagtcctataagcattttcaatctctcttgttgaacaccactagtggagacaatgaaagaagaaaaatgcaatatacgtgtccaaggatctctcaggttgccttacagacaaatattataattcatggttttgtataagatatttttctgctgttatttttatgttaagtatggctttttggattctaagaaccatataacaaggtgctgcattccagtccagcttgaattttgtctcatggagcttatgaacaagtgacaacataccttcttgcacagaaaatcagtaacctgcagactgcccagagagggtttcccaggctttttcctgtctctattgtttggctactcccaatttcagggataaaggaaaaaattcttgctgtgaagaactgctgtggagattctgcaatgagatatgtgtgaacagatgtttgctttctaccacttccatgactttccaaaggccagatattgatgtttctctgtggggagtgtaattatgctctcatcatattgacatggagagagagaatcaggcttgttgagttttacaaagttacaaagctggtgggtctgcttttctgttaattgtgaaacctgggaagataatttttaaaactttgcatgcctcttggatgccatttcaatgtatttgctttttttgatagctataatgattatagaatttttataataatcaatgtatctgcaaaagagaaaggaaaggtgagatttgtcaaatctacataatatattgaaaggtggtaacagaataaacattgaacaaaatgatttaaaattgcaacatactgtcagcatcctatcagcaaacatatctttctaattataaaaaatcccaaatgacaaaaccatgattgttgatgctgtaattcatttagattctcttttatggctgaaagctctgtaagctacaatatggacataagaaatctatcactactctggaatatctcagaggggaatggatgatgccacttcctatcaccaagttaaaaaaaaaaacaaaacttgtagtgcctttttagttgaagcaaaattgtgatgaaagccagctgttaagtaattttcaaaataaatgactgctaaactagtgaaaacgtctcaacataatttcaagttcgacatcataaagtgaatgtgacattaaataagcttcgtaagccaggcacagtggctcacgtctgtaatcccagcactttgggaggctgaggtgggtggatcttgaggtcaggagcacgagaccagcctgaccaacatggtgaaaccctgcctccactaaaaatacaaaaattagctgggtatggtgtcgggtgcctgtaatcccagctactcaggaggcggaggcaggagaatcacttgaacctgggaggtggaggttgcagtgagccgagatcgtgccactgcactccagcctggaagacagagtgagactccatctcaaaaaaaaaaaaaaaaaagtattgtaggctacatttggagtagcactttgacatacattttgagacatttttgaactaagagtccattcaaaactctttccagtgcatatccttgctctcttgcgtagaccttctaattaaaatggaagccagttacatttcttttctctgagagtctcaaagtccagtggagggtcagcctgacattttactttgctgaaacaagcttgtcaatggtgactatattgaaatgaaaagtaattgtttcattttgggtgaaataatatcatttcaaagcaatatcacaaattactgtctgatcattttgaagcgatatctagcagtaatattttatactgagtggtttagtcacatatgcctttgtaagatattaaacatctaagtgaaaaatcaagaccatggttagaatattttactagcaaattatattcactgaagaagagagtggttcagttatgtaggtgcaattgaaagaggaaagtgaaagtcaaagtgaaaaatctaatttttttctcgctgaaaaattcaacatctgagatgtgtagtaatcatagattttacaatcataaactaatcttacctgtgtatatgatactctgctaaaatatcataggaacaaggcttgcaaatataatattaaagacaaatgtgtcagcttataatgtcaaatattaaacaaataagaggtcattttgacaaggagttgtgttgtgttttgaaggctctgaactaattgatcctagtctttctcttgaaaggacaactaatgtcaaatttactgtaagaaaagttactttccacagtttcaatgaaaacaggaccatcataactcttgccttataacttcatatttctttagaaacatttaataagtgtagttttagcaggttaagtagataagggtaactaggagagtcgataatacatttgttattaatgaggcttctacatgccatcatgtgaatatagatatactggtcttagtatcaaagatttcatgaaagagcaaaaatttatctagcactatatttactatctctatagaggggatgaaggacagataatttttctgttccaaattatacactgttcacaacgttattaaatttttattaagaatgctagataacctaaacagcttttaaaaatacagcacattctcattattcatggattctgtatttgcaaatttgcccactcattaaaatgtatttgtaaacacaaaatcaatgctggtggcacttacggtcgtttgcggtcatgtgcagagtggcaaaaaagtttcatttgcctgatgcatatgtcctagctgggcttgaacgtggtaacagtcttctttcagctcatactataaacaaacgtccttttcatggtgaatttagtgcaacattttctcatttttgtgctatttcttgctgattttactgttttcaatggcctccaagtatagcgttgctatgctgcctagtgtttcttaacatgagaaggctatggaaagccttaaaagaaaatatgtgtgttagataagttgttttcaggcatgacttacagtgttgtttgactttcaaagttagattcaacagcatgttaaataaagtgtctctaaaagaaacacacataagacaagtttacgtattaattggttgatgaaaatgttgtgaccagaggcttatagggatctaactctgtctttcctgcagaaacagtggttcagtatttgctactttggtgttggcagcatctttatagaacaaaactactgtgaataacaagaattgatagtaccacagtttttaccccatattattcacaaacacaagcaaaaagacatcttatgtcatggtaaaatgaactgtaagaacttgcttgtgtgtaaacattcctaattatgatgacaaattaaatttagtgaaatacacaggcccataattgagaaatgtgtaatcactactaggttaacatagaaatactgtataaacagatgactgtagggatatcaagaagatggttggtatatggagaggtttaatgattaaatgttctgtaattaatacctttgtttaatctttttaaggctcatgcaatccaaatacattgtcagcagacttttcaaaaactgctattaaaaacagtctaggcatagtcatacatctgtaatcccagcactttgggaggctgagacaagaggatcacttgaggccaggagtttgagactagcctgggcaacatagtgaaacccccatttctgcaaaaaatttaaaaattagctgggcatggtggcctctgcctatagacccagctaggtgaggggctgagatgggaggatttcctcagcctgggaggtcgaggctacagtgagccatcatccctccactttattccagcctgggtgacagagtgagatcctgtctcaaaaaaaaaaaaaaaaaaaaagtataggattttaagagattaattttcaattactaatttcaaaggcataggtctcaattaaaagaatttgataatccttagcatttgatcacatttgggagcatttttcattttgtgtctgtgaatttcatgcactaggcccgcgttcagtccagccaccagatcaacacattctccaaactcattaactttggagaggctacccagagttcctgaagagttcatctgaaagtaagtaggaaagatattttctctctgacttttcagctcttttcaatatttatgtactgtggttaaactgccttagccattcaagaagcatttgattgtatctttgttgaatttttaaagatgtgagtcttgattgcagatgcctagaaaaatgctagattgctagtaaataagcctggtagtaacagtctctccttggcatttactaaaaacagtgtaaaaaatgagtcaatgattaatttttcccttggctatggaccagaactgaagtttaatagaacacaaatttcataatatgtagcagctgaaaaaactttcagttaaaactggttcaattttatctggctttaaagactgtccctgagagcatctcagattcacctgcatgattccttaaaacggcaactttatgcaagtgactatttagctctgcagactgaaagagttgccatgttgcactgcaaagcaagttaaatgggggaaatgtgtttccagctatgaatctaatcagaaggtaggtattttttaaaacacgtaagttgctgaaagacgttcagaaatacgagtttactaggttagctctactagctaatctaaactcaaaacaacataaagtcaaagtaattctaatgagcatttggtgcatgggtcccagataaatggatttctaagtaaaagtcaaagctacattaagtcttcgttacaccaatccaaacaactttgcctttgagtgtagatgtgggctgccacacaggcaaatgtatacattatatagtctttgttgctaatatgttaaattagatttttatttttactatagcataggatgcgtaacagtgaccttcatttgatttacatttattacaaaataaattgcatcaatattttagaagtggaaaatcatagtgattctccaattccatactaagactgagaaatgtttctagaaagagctgtgagatgacactaaactgactgtgttctgttacattccttcgcatcgtggccagacttttcttctgtctttgagatacttttatttgcctctcactgaatttacatctctctatatttcccactgtacccaagctattttttgcattcttcttacccccaggactacctgaaagccattattgcaggtgctgattaggaaatgttccatggcctctctccaggaccttcattcaatcatctcccatgccccttcactttttctaatccttgctccaataattattcataatctccttgcaattttcacctcttgtctattgacatatcatgctgcctaaaaactatgctcttctcttaatgtgttgccttccattcaccaataaatttattaacatgagaattgttagtatcctacctattgtgctctgacaatctgactcacttatgtgctgttgaattcttctttttctggaaaaataatgttaccaataatgggctgatatcaaagggagaagcatcatagattagtagttaggacatgagctctgaatcagcctttgctttacctgtctcactttttgcagtatctcgagcaagtttctatgcgctgcatttcctcgtctgtaaaatgaagaacataatagtacctacctcatagggtggttctgaggcttaaataaaacaatacttgtaaaacactaacagagcactcagcacataggaagcatgataagtatatgttaaataaaataaatgtaatacttatttcctctattatcctctccattgacctcttagcagcatttaatagtattgattaccactttagaaaactttcatgctcggtgaaattttgcagcctggcaagtggactggtggaaagcacagaagatccagagtgttaggcacatttggtggccagctagtgtttaattgaaatgtctgatttgggggctcagcctaagtagagtgacatgtaaaatgagacttggagctatgagtgtagaacgtggaattttgagaatttagggatcattatgagaataggttctatggaaatgagaaaaatggtagtttaggtggagaagaaatgaattgtggttgaagagatctacggctgtgaagctcttgctttagagtggttttcagccccagactacagctagtgatgaaggcgagaaagagaactgtgggtcaggtgcccttagggcacccctgaaagttagacgcaaggggaaaggaagagcagctactgagttaggtacactttcagtcatttcagagccaatgcttcctggatgatttgaagttatttattttgtcccattgtacctgccttttggccactgaaatttttattatttacaactctcactacaaactaggcaaaagaaataaatattagggtgatctgtcaattttaacaaccattgctatcttagggttggctgttctttattctcataatgtcccagtacgacatgttgtgattacttattccacttttggagacaactagagaaatgaagaagtctgaattaggtcgtccaggggacccacagctgaatcagcatgagaactaacagttcctaactcccacccgaaactttacatcttctaaatcataatagctcctaagggaaaataactgtgaacaggttctagagattgcgattgtcttccaaaatggaactgatatttgggttttttaaaaaaattcaacacaattttattttggtctttacagtgacgtttatatatttacagttcatctgctgctgaaacagcagtagaatagagtctttgaagtgatgggtatgtgtgtattggcagagttgaagataaacaatgccaaaagacctctaaaaagattagactgttaaccacaaatacgcggtttcagttgagaagatttatttgttgctgaccatattagccattgtagttaacattggttctgggaaagtcatactttggtaatgagccagcaggctgtatttgtagaactacagttgaatttataggatggatgcagtgacattgcagattttctcaacatcaaacagttaatgaagttacaaaatgttctgctggctcttttcctttaagcttctttttggcgcttctaagagtttcaactgtcagatgcacggtcttccagcgttctatccatctgtttccctgtcttggttcatgcgctaaaatgtggtgctcataaaacatggtccttatggacatgattatgtttgtctgagaactcttcaagcggccacttgagataaaagataatggaactagggatagaagtgggtgtaatggaattggagtggtgtcatgaggtaattggcaggtacaaatggccaatcacgtggctgggtactgatctgagcccctagtccatttcaagccctactggatgtattgcaattcagtcctggaactaaccatctggagttggtggtacaggctctataggttaaaggtatggtctccgacaaggctgctcttacttcagacaccagcagcactgaggtggggggtctccagaccacctgcactcctgaaagactgactatacgttttggggttttcatgagcgcttcagttcaataatttgctagaatggcttacaaaactcaggaaagtactataattagaattatagtttcattacaaagaatacaagtcaggagtgctagctaaatatgggacacacagaatgaggtctgaaatggaatgcaaattttctgtctccagccccactccactcccctggagtcaggtggctgaaagccccaaacttctaattgtgtggttagtctttcaaggtgactgtccccattctaaagttatctagaggcctaccacgagtcccctcattaggataatgtggatgatcactcattaggataatcaccgtgaacattctgagaatttttggaactctgtcccgtgaatctggaacaaagaccatacagattctttatgataccacagccctctcctgcactctcttatttaaggtttacagaaattctgtgaaataggtatttttcatccctactttttaacatgagaaaactaaagatcagaaatgtaacatttatatgccccaggtcacacagcaagaacacagcagaacaaagattagatcccagcttggtcttcttcaatggtcatgcttttccagataccttaaagaaaaccaaatggacagtgattctacactgacagataagcatgcttataattgcttgtttgatatctgttttttccctggtagtttgtaagatgtgaaagaaaaaatatgtgttgccttttctgacagccactcccccaaccccagcacctagtatatattattttctattagctgttaaataaatacttaccatatgaacaagtgaacctgaataaagcagtactcattggtcctggagtggatgaaatagactagggactggccagctagaaggatcagggactcccaaatatgtagcatttttagttggtactgaatgtgtgaatgagatgggtagctatggcatccaggctaggtgaagtcagttataggcatggatgtggaggactctgtgggagggaaagagtgagtggttcagggcactggaggtcatgcagagatttgatgctatgaaaagcaagttgcacctgtgagagtgtcattaggttaataacaccctcctcttctgtctgcctccctcacaatcatgaggcttggaaaagtgagggatggaagttattatctaggagcttgttcactgctgccaaaaatagttagctttattatgagctcttgtactggcttcagacagagcctttgggcatcatgggagttactgctgcttcccttgggaactactgtcactgccatgggcatctgcatctgagaagcattccttctctgtgacaattatcatagtaacttttgcccagcaagttggcttttctggatgtgttaatgatggtaataatgataattgctaagattatgaatgtcttgcatgaattatttcatttaatcctcacaataaccgaatgaggcagaaacaattttgtgtcttttttacaaatggggaactgagatttggggaagttaaatcatttgccaaagtcatttgttcaatgatgagtagtctcaaaattttaacccaaatctaatcaacatattgtaagattgttacagtaagaatgttattagaacatcctgagaaagagctgatatacatattaaagagtccttcattttcgtgatgcctactccttgcttgggtgcaaggttatttctgcttgttgattctgtccctttgaaaatcagattttaacctctagcctgctagttcctttgtggggaaaaatgattattgctgttttccaaaataccaaaaaatgtcagcccaaccgcctgagtttaatcagatgtttaatctgatatagcatctgcataatgacaccacaaagaataaacaagaagatcgggactgtgtcataaatattgattcttctatagtcagggcctgctgactttcatataaaactttttatttaattaaatctattgcaaacaatgcagcaaaaccttattctagttttatctttcagaatgttgaaatagtcacagcccatggaatcaatgttttgggtaagattttttttaatggaattctgtctctattgctttaatttctttaatctttcactgcatgaaaaatactctaatatcttaaaatttcatgtatttccagcctaaaaataacatctattatagattttcctcattttattgtgtaaatgtagataagcataaagaagaaaataaaaattgtccagaaagaaccacaatt

SEQ ID NO: 1362 - DNA, 89302 bp, Homo sapiens
gctttacactcgcgagcggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggtaagcgggcgtccgggccgatcagggggccggtccgaggccagggccgggctgcgcggggcaggcgcgaccgagagtggttgggagaagagtgctgagaggtcttcggagctcgaggctcggtttggagggctgtgagggggagagcatgtgcccggtttgggggcgcggatcagcagctttgcagtggagacttctgcggctcggaggagtcggggatttgcgcgcacggcgaggccaggaggccgagggagatggcctggaggtcggaggtgcttccgcggtgcctttgaaaatctcccagccgccccgcagcagattaccgtggccaccggcgcttggaaatgtttgtgggtgcatgtcctcgactttctctggtctctcattttggggcagcatccacgtctctatttttctctggattcgcggagtccttccaaatgcgctcctgtgcccgcgccgcggcccaagtgggcaaaggggggcgggaggcggagagcggctcagggacacgatcctaccgaggagccaggacccttcagagcgccccgctgccgggctccagaccccaccgaaggttggagaacccacttcctcgtgccgcaccttgactctggggagagtaggtagtgagtgacctggattgccctgcgggggcagatggttcggtgtgtaggaagcggacggcaacactggatgtccctggcaggtccgggtgtctgtctccgaagaggacagagaagggcagccacgatctgcccgcctgccctcgcgagcctctcggcactgggtgagaggcaactctggccatttcttgctgccctctcgccctctcccggccgctcccagtccagccgggcccggcgctacccgagcgagggttcgagccctctgcgcggccgcgcagaagcaggcagggcctcaacttctgcaaatgtgtgcggctcgccgcctgtcccctttctcctcctgtctccacccgtgcggccccagtggcctggagcttccagccccgcgcttggccgcggcttggcgaggctatgctgcgggaagctggaatccaacgcgcggccggctgaaccgcctgagccgcgggaaaccagcggcggagcggcggtatagaggtgcgaggatgaggaggaccgactcgctaagggagggaggtgactggccgggagggctcactgccgaggttgatttgctcttgttccaacttccactacgggactggagccagaaaccgtgtatcctccggtcgaaagcagcggttcccacctcggggcaccgataaggatttgataaacgggagcgaatcgcgcctgtcctggctcggcgcccgggcccttcactgcgggatcgctaggggaggggattgggccctgctcccctttcctggccgtagtcccccctttctcgtcaccgtcgcgccctcagacccaagacaagtgagggagccctgagactgcagccggcacattcccagggccctcggagcagtcctggggttccatgtcttttgaaggcagcagagcaaggaaaagactcttaagattccagtgcgttttgtaaaaaccaatcataatgctaataatgactgaaccatcgaaaagcaaagttatagacagcgcctgcagacgctttcgggtccggagccggggagggaacttgtgtattttacaactgcgatgcctatcgggaatgtggcaatcgccgaggtggggcctgacagtaatcttgacaaatgtgtgaagtgtcagctcctcctgcgctccttagcgccgggttttgtgcagttttgtaccgtatataccgagaaacttgggagcaggggaaaaatgatttcgacacacccagctacagtacctggttcgttagcggactgttggaaagagagaagaagcgggaatgggagcgggaagaacgttgcgtaattagactcccaattattggcgagagcggccgctttaagaaccactgtggggactgcctgcgaaacgccttggaggccgctgtgtgagctgcggctccgggctggtggccacgcgagggtgtccgccctcttcgacctgcctggatttttgtgctgcagaatggcagggcaaacagcgtgtccttcaccatctagagccccttaaggggttgtccaattcctattgggctaatcagtttgagactcatttacttttcgtgcctgggtctgtttgctggctgcaggcttctttagggaccaagatgtaattaaaatatgtgaaccaatacattgaaagttggtgttgtcatgtaagtgactgctgtagcttttctgagtgcctcacaagggcgatgtgacagtgagggggctctctgctgatgattctgcccactagttcttacattttgtgtttctttggtttagcagagcagtttcttcccccaaatgcaatatgggcagaacatttggaatattcgttctaacaatggcccgtcaagaagtgggcagatgattttgtcccagaatgttcacacgtcgataaatatgttaatgtttaataataaagagtttgctttctaaatgttagttggctgggtgtccttgatagtaccagttttggtggtagtgggcatttgcggtgacatcacagatgtcagaaactgaagcctggtgggtgggggtactgcactttcactcacctttttgtgcacgcatctatcaggaatgcctgagtcctttcactgggaaaaaaatgtggaaattctgggattcacggggtttgaggagtggttcaggcaaatgtaaatgagatccttggataatcagggatcaaagtccagtcccaaagccagacctaggtccagacaccttcccagagtgcttatacagtagtgctcagtacagggctagcgtggaaggggaattggagacacctggatctccaatctccccctccttctgacagctggacttagttgttcctcttctaaaatcaaatcaaactccatcattattccaactctgaagggaaaaaatattgctggacagtttctctcaatttaaacatatattttaaataaatattccctccacacttgatatgtttccattgtattaccagcagcgcaggatgatacagaattgatgtaacacattgttggcttgagtatttaagttttaattcatacagttttcatgaagttcaaaagaatgccatcatttcaagtttttttcagtggtgcttatagggagcctagaattattttataagagaccatggaaatcatctagtcagacttttctctttctggataaggaaactgatgccgagagaggttaaaagacttctccggtcacaaggaaaattagtgctgataagagtcagggctggtcgcggtggctcatgcctgtaatcccagcactttgggaggctgaggctgcggatcacctgaggtcaggagttcaagaccagcctggtcaacatggtgaaaccccgtctctattaaaaacacaaaaaaattagccgggcgtggtggtgggtgcctgtaatcccagctattctggaggctgaggcaggagaattgcttgaacccgggaggtagaggctgcagtgagcggagatagcgctgctgcactccagcctgggcaagagtgaaattccgtctcaaagaaaaaaaaaaaaaaaaaagtcagaaccctggtttattactttcaattaagtatgtattttcctattgttcacaggagagtaccccagccctgaaatatctctagatagtgaggatgatttccgaaggagtgccttccccatcacaactctcaaaccgctgaaccttatagaaaggagatttgcttttctggataattatcaacacctttaggctgcagtagaagtgatgattctgtttgctttttgaaaaaaaaaaaaaaaggaagcagagttgaattgatgctgttcccagtgtctgtaaactttgagaagtatgaattcattgttttagttagaaaaaaatctacttatataggtagacctcattaaacaaaaccaatgcaaggaccgctcctcagtggagcagattgctttttgaggtagagaacattcaagcagctgctagattgatttttgtactgggttagttggcattttcactaggagtgaaaactgtgagactaaacagtttaatttacttagaatgtccctctttctctctgtgtgtgtgtgtgtgtgtgtgtgtgtgtgtgcccgtgcgtcgggggggggggcagtggtgattctcaactttctaggaatttattaagtaaagtgtttagaaatggaaggaaacaattagataattctcagtgctccaggattttaggctcctacatttgaaaatacttgctgtcattaattgtcttgagatttaggcttttccacttttcaggaaatctagtagttttttgggggttttgttttgttttccttggttctgccctatgccaacctgctagtttccctttttattttagcctgatgaatcttcccttttgctttcagtactaaccattgctggtagttcttaacaggtctagcttttaccaatattgtcaagttagcaatattagctcctggggccctagtactctgtacttccacccctctccccaccagtaccatgctgcctgttcacatgatggacaccagctctgatattcaccctaagatataatccataagatgacaaacttgtattcaacaccgactcctactctggctaaaatgctgaagagaatactaagaaataggggatatggtcctggtcatcaagttgcttagtctgattaggaaaaaaaaaaaaaaaaaaaaaaaagagatacaaggaagcttaagtaaaaatataaggggttgggcgtggtaactcatgcctgtaatcccagcactttgagaggccgaggcaggcagatcacgaggtcaggagtttgagaccagcctggccaatatggtgaaaccccatctctactaaaaatacaaaaaattagccaggcgtggtggcgtatgcctgtagtcccagctactcaagaggctgaggcaggagaatcgcttgaacccgggaggcggaggttgcagtgagccgagatcgtgccactgcactccagcgtgggtgacagagcgagacaacgtcaaagaaagaaagaaaagaaagaaaatataaagagctgacagcctacatgcttttctgtagaaatctaatattttgaagcaaaagataagctctgagtagcatttcaggtaataaccgcccccctccccaacacacacataagcacacacaattatttaagagtattatgtgtatttagaggtggagaaatttgttcctagtgtccccggaaccacacagagtaggtgctgaccaccagcttaaagactggctcagaaggaaggtcaaatgggagaaggcagtctttgagggctaacgagaggaaagaaaacacacaaggctccctatggtgtatcccttatcatgtacttcgacaccatacacaggaaggcccctgaaatggaatgtttgctgttctttatacacttgctttgggtggggacatggaaagggagctggtggggctccacagacaacaggggtagtaatttctgttcccctgagaatatcagtggagacagctatgactccaggaaggccaagaagggagagggagcttcttaaccaggctttgtgaatgggtttcagaggctggcgtgtaaatctctgaaaatgtgtgcaagacattatgtatagaagcaacttgttctaaaggaagtctgttcagctctccatagcctttcaaaggttctaggatatggaaaaggcaagcccttgctcttggatgtctgatttggtgactgtcttatgtttcagagtcttcctgttcagatcccagacagttcttgtgttttactgccattgcctctccctgtggtgaagaatggggaggaggaaggtgtgtgtatttagtaaaggttctgaggtgccgcttaatcttccctgtccctggctggcgtgtccgtccacctacatgtctgccctcagtcttggaaggacgggaagccaagtgccctgcacagggtaaatactggtatgattcattttattaatgcttctgaaaaatgactgtgaaaacaaatttatcctcaaatgttccatcatcctcaaacagttatttggatgaccttcatgttctaggaatgtatgtggtcttaatagaaattatattttgcatcaggacaacacaaaaaactgacagtcttatttgtgccagtgccgtcctcagaactttacatggattaactttttaatcctgtgagataagccctgttattatccccacttcattgatgggaaagctgaagtctagaagggctaactgcccaaggtcgtataggtagcatgggcagagctgcattcaacctgagtaaaggaggtccccagagtctatactctcaatgggtgttccatacgcccttcccttactgaagatatctataaagtatttaatactgcttctgactcacaataagtgctctataaatgacaactgcctttgttgttttccttgtaattataattacttttcttttttgtgatttatcacttgcatcaaacctcacaagcagatagggattgaagatctgaaaggccaacatggaactccttgaatttcttatttttcatgggttttcctagaccctgacaagaggtggttctctcctgccccaagaaattcaaagctttccacatcccacccttcgctggtggcaagacttcaataattacttcagccttcggactccattgtgcaggagaacctgttagaagctcttcctctgtggcttctgaagaaccatcaagatgcacaggacttcctgtggctcttttgatcttttgaaattgcaagcacaggaaggaaagaatggatagggggataaagaatagctatgattgttgtgataatagcatgttgcatttctatagagccctttcgctgatgagccctgagccttaacagccatcacactgttggcccctgcactgtgaacctagagggtaccttgagtttttctagtgctgccaaacagaattgcattgacacataccttaatcaagagagaagcaagccgtgttggcaactgtgcatcacagtcgatgtggtggtcatccatgggatgcccctaatagcatctgtaattttcaagtagatgttgggtgtaatttggtgacccttgtctgttcccactgttggaagccccataactgatctgatgaaagcataaagtgaagaagagtggcgagaccctttgtgagatacctggagctgaagagtcaggtgtggaatggacaagaatgttatccacttctaagtgaccttgttttttctaatttcttaagaaatacctgtttgcttgactgccttaggctgtttgcaggggccacttgtacgtcagcaaaactcttactagatgacatcactgccagaagttccacatgtttccaggaggcacatttcccactgcccccactcccccgaacttggaaagattcctcagttttaaagttataagtaatttccatgccagataatgatcctgtgaacagatccttttctcatgtggaaaaatatttcagaaagggtgtcttgtcaatgagaaaaatgaccccattgaaacatatgtttatttgccatgtactcatctgacgttttgtgaattctataaagccatggaagtggattgttagaagtgtctcatacacccctagtgacttcttgaactatccccccatccccagccatggaactctcctattaaaaaaactaagagataagtggtagcaatcttaacaaattagtgattttatctggttaggccgtgtaatcaaacacgtgggcaggaaagtggatccattatgttgtactcatgattgtggtgctgaaggtaacccccattgccctgtaggctgcccccagaagcagggggtacagccaatagtattcttagaagttaatcaattctgtaacgggttgagtgttttggtctcatttttagtccgaggtgccctgatgctggcctgtgactaaggggagtcagtggcttgttatgaataagaggacacatgagctgaatctgagaaagttcagaagcattttataagttgtttaaaatacatccattaaagtatatgattattttttggtaatcatttaaatcattgtgctgtgtgtctacccagacagtatttatctgtctctcgatgttgtattagtatagtattaaaaaaatacacacatttcacttttgataaaaactttgcatactgtcactactttgtataagttttttcctgactgcctctggttagggggcagggagcaagaagaccagcatgctttccttcctttatatttgggaaatggaggtgctgagagaaacaagccacactgtctgaagtaaaacctagaagtggacctggttgtccatggtgagggaaagcccatatgtaccaccttgggctccagttacaaggtaatgagccatgagcacaaaagggtgactcaaaattcaatgccagccattctcattactaatgagcaattacagcaaatatttacaggcctccttcctacctttatgacttcctgttactgaagcactttggagtattgagaaagattgtcctggaaaaatacgtcacacacagttgcaggaaagagtgcctttaagcacacataaaaactcggttacttggctttgtttatgaattccacatagaaacaacagaaaattgtgccttttgaggaactgcttgagaatccttccttctgcatttcaagacaagattttaaaaatcacatatatcaaatatatggggaaatgagacacaatgtttttagagagtgtctagaaataataggactgtgcaagttagtacagcaaaattttgggtcaaagcatgggtcatttgacaaactctctttatgaacattacctctgcaatatttttctaaatgaaaacaatcacacttaatagaattaatcaggatgggagctagaagcatataattcactttccacagattggagtaaatcctcataatgcccctttcctgtgtatttagttaaaaaagcactccagtgagattgctttcgcagtaagtttctgtaaaccactgtacccttgtatttctctcctgtgtttccaagagttctcagatgctattttcgaatggcagcgttcactccagagctggctgaggtcaacgaagctaattttggtgccttggtgcccagggtgaagggagagagaagtcctctgcagagccaaaaggactctctggggcctgggtttggagcagtgtggtgttgctggacacaccacatttcacctttagaacctttatttgtgtgcttgcacaacaaatgtttacccagatattaagataaggaaagtatgaaggtcacatttcactggtgacaagagagcttctataaatgtaaccatatcgttgtgcagcgggagtctgtcttttattctgtacccgggacttagggggaattattggtgggtggggcatgggagttgaggctcttcttggttttctggctttcttgctatcactctgtttgtcttgcctcagctgatgtgcgcctcccatttggtaagggcctttgtcatggccaagacatctaaagaaatcctagtctgtgtggctgggcactgtgtggtcccctgactctctggagtcttccagagttccatggaaattagtgcccccgtgcatttccctgccgactgactggaaggcaccctggctgctgagatcgctttcctggtcccccagaagaggtccacatggtgctgatcctgcagctgttttaggcctcctcagcgggattgtcctatcctcggagcacagagaatcttcagagtgggataggggtttcttttgtggatttgggtttctcttagggatctccaaagattagctagacactcagggcctcagtaaagacatgggtccttggtctagttttcttcccaagggcagccaccatggcagtgggagttcaccttgctgactgcaagggaccccacctcacctctatcgcccattcaccatcattcactgtgcctcctgagttcctaatacacaagcctcctcccacagcctcaaaggcagtgctgcagtactcattcccacttctattccctcacactagctcctccatctggatgcttttcccctctcttcctattcaaatagctcctacttttctattgtgagcccaggcttcccgaaatcttacacaaaatcactaagggagcgtagaaatttccacagtggcactcccactccctgcattactagcttttggttgtttgccaaagagcctgcttatatttccttgttatctaatgacactttatttgtttttgcctttctaacaatatagcatgttcctgaaggccaaggatgtctgattttctgatgtgccctaataccttgcttgcttttttttgggggggggggctctgaaatcatgcttagttttttaaaaaaaataatagaattgctttgttcatgtcccttgggttacttggaaagcctgcctcacaagctctgctttctttattcatgtagatttgacccctttacttatttccctttaaaaagaaagaaaaaggaaaagaaaaaatttgggggaccacagtcaggtcttattgatacataactttatatcagatgcaaacgtcaggctagtattatatcagtgcttcacttcaagaatgccttatacactaatgtgagtacagccaaacagaatactccagcttaatctcaacgttaaaagcaagatggggaagttgtgcaagagggcactagctctcagttcagagatcatcttccctgggaagccttccctgattaactgcacattggttacccctgtgtttatagatggtcttcagtctgtattttgttatttgtatgatgcttttacaacttgcttttgaaggttgggggtggcgtatgtccctgatcaccactcaagtggtaagcccttcaagagcaaagacccagtcattttttcctgttcttttttccccacagaagtcagaatagaggtctcttgaggtgctcagtaattatttgtagactgagtaattctgtctatgtcaggaactttgggagtttggtgtagagaactggaagcacaggtagacactttgctcacatcaacctaacttatcctcattgcttatccaccatgcgtagagcagggtttgtgggaatcatcactgtgtgtagatgtttataggttccctcccaaattcaggtgctatgctgtacggtgaggttacaaagaggcattagatggaccctgcactcaggatgtcctaaaatgatttgtttaagcaatataagatgatttatgttaatggatgtccaagctgcctttacaatgttgccatcttgttaggaagtcacaaccaactcagataaaacattgagcaaacaatggaagattgatagtaattaagtgagagtgagtaagggtaaatagatcttgtgtgttgggaatagttagggaagtgattagtggagattagagggaggtttattggaggagcatgaagacctaggtctgtcttgaagattaggtagaatttggataggcagatgagtatggggcattccatttgaggtgaattgcgtaagtaaaatgagaaggcagcaataaacagagtgtgcaggccaggactggtgagccagttccttccagggctggatctggagctctgttagcagaaaggagatgaggaccaggcctgggctggtgttgggaagtttaggggcaggccttcctgagtcatgttgtgatggaatctttgggttgccttggggccatgggagcagtgcatgcctcttctggcacatgagaagctgctcagggcatctccatcattagccctccaaccagaagcctagctctagtgtgagcatcaagtgggtggttggaggaggccatgatttgtcttctataatattgacctcaaagcctcccctgctagcccttagtaaatcaggcatgtgtgaatgtgcccaaatcactctgatatatgtttctttttggcctgtaccacttctcagggtaataaacgccatgtctgagtctcctagtgcatggagtgggagctggaagaggacagcttgctgtatcctaaaatagcagtgaccctcatccccatgttctctttctgatggtaaagactttgtccccctcattatttgataaggttctctttctgatggtaaagcctttgtccccctcattatttgataaggctctcattctgtccctttctcattctggattctaggtttttgagtctaaccattatggaaagagaacagtcccttcaatatcccactatctgtagggcatgacacagccaaatccaagtcagaccatccctttgatcaatttctaccaataactgttcattgcacaccctgtacaaagcactgcgaccaagctgttccttgaccttctcctttcctagtgtttggtcacaacactccctaaagccctaactcaagttcttgggatgataccaccagaagagggaaaaaaggagccgtcttcctgaagtcacctgggtagagcagctggggatttttccctcctcgagcaggtgtaacctttcccctggaggaatttagaaacacttaaagtcatacctgaacactgtgggccaggccttggccagagatcccaagtcactggagaagattccattccagggaccagtagaggccagcgggtctcatccaagtcactttagctcattctgtccaccggtactttgagggaggctatataactcctgagtacttttggcttagaatttaacctcacaatgacaactgcgtgtttggcctttttttttgagacggagtctcgctctgttgcccaggctggagtgcagtggcacgatcttggctcactgcaagctctgcctcccaggttcacgccattctcctgcctcagcctccccagtagttgggactacaggtgcctgccacgatgcccagctaattttttttgtatttttagtagagacggggtttcaccgtgttaaccaggatggtctcgatctcctgacctgtgatccacccgcctcggcctcccaaagtgctgagattacaggcgtgagccactgcacccagcatatttggcctcttattccttttctgtccctctagtaatcaataaatgcttgtaaaactgggaaactgctgcctggcccaggcaggattggttggttcaatgactcgctccacagtcattctctgctcattgcctactctgtgcaggctgctgagcctcaggcccgagagcagggaagggccctctacagttaggtggaaaggagcctggactgtcagaaccaggaaaagactgcaggtgccagagagctttggagcacagcgcagcccaaactaagggactagtttcaagaatctcctaagaactcccctaggctagaaagtgttgtttacccaaatcttgccatggctagaaatttgagtctagcatctaccttctcacagctccaggtggacctccagaaggaaaaggaagatgtcctaccaagctaacctgtgactagatatctgttagggtgtgaaacctgtgaacatatccacgtcttttcctttgtgttcatttccttttctcttcctttttaaagtaaaacatccttttgaaaagttccaactttgcctttgctgaactcctagcaagtacttttccccaccttggctagtgagatgttgagacatgggcacacctgagggtggtgtggtcactgtggccgccagccagcccaaggccttgggaaagcctggtgagcagaaaacccaggcagaaaggagtctgggtgactgtgagcattgatccctttgttcctgagtcatctcttttgagcacatttgaaaccattttccatacccaaatcaacataatcttggtgattccaggccacctgtatctccttgtatggctccaaatattaccagggcaatgacgacaacttaattcttcttgagttagatcttcagggccaaggcacagtacatgtttattttggagagagacaaactttcacccacttgaatttctttgcctccaaaattagcgttgggatgaccacagggttctgtgtttcttggcttttatcttgccaaacggattgtaaatgctcccgagtcaccttctctttttttgtgtccctggcaaagcctacctccacatggggttcagaggagctctcaagtctctaggagtttgaaagacttttctagatctttctctgatgtgtgtgacctaggacaggtaatttaacctttctttctttaacccctttcctaagtggggttagacatatttgctgctttctcagagtactattatgagtttgaaatgagctagagtttcataaaaccatgcatttttaaagtctattatattttaaaaatcacttttgcaactattatctcaatagaactttgaaaagtttaaagggcagaccttcaaggcatcattattaacaagcacagcaatataatcattaggcacattattgcctgttgatgtgatttggctgcagttggaaggcagccttaggaaaagctaggggactcttgctctcaggcctttaaatttcttacctggctgggattttcagaattattagtttttactaataatgatttttgggtatcagttctatttttgcccataccctgagatgtgaggaaatctgattatacccaagagaccaaggacacttccaggattctagataaagggtctgaccagttatgctcctttctacatctggcctgtttttccctcccctgtggagatggaggtggtttgtgcaagatgtgattctgtcgagaatgggaatatcccttcaactcagcacacccaaatctctaaacctaaagagctacatctgtaccatgtctgctcaggtcctacttgttgctttgcatcttatgagcaagacctaattgtgggctcccaaagaaagcagatgacttgcccaaggtctttaagaggtcagacagctactagcagagaaacagagcgaatgttgacacctaaaagataccttgtccttccggtgttactagaagtgggaaaaaggctttgagtgcaaacgcctggctgtgctacatactgaccatgagatgtgacaggccactcagctctggcctctgatccttcatctgtaacatctttgatgcccctaatgcctaagcttgctcatccctcagccccacccatgaggctggccagttaacttctgccttcaggtctcagcttaaatatcacctccctagggaagcattttctcacctcctttagttaacctccctcctgttctgttttgttttgttttagcagtacttcccacatgttgttatttatttatttatttatttatttatttttgagacagtgtctcactctgtcgccaggctgcagtgcaatggcgggatctcagctcactgcaacctctacctcccaggttcaagcgattctcccacctcggcttcctgagtagcggggattacaggcacgcaccaccatgccaggctaatatttgtatttttagtagagatggggtttcaccatgttggccaggctggtctcaaactctgacctcaggtgatctgcccgccttggcctcccaaagtgctgggattacaggcatgagccacggtgaccagccccacatgtcataatttatttgcttatcatctgtcacctttgctgccccctagtatgtaagcttcatgaaggcagggaccatgcattacatggttactgccatatcctcagggtttggggcagtgcctacacacaggaggtgctccttaaatgtttgttaagtgaaataatctgaggttgtcaggtctttgtcttcaacgttattatttcttatatttgttcagtgcttaattttttttcaaagctcttgatgtagattgaagcttttgtcatttttgtcatatagatgaaacaactgaggcacaaaaatgtgatcacaaaaccagagagtggcagtgcctacctgaacagctcccagacccagactctttccacagacccatgctgtctctcttggcaccttatttttctgtcgtggtgatgttattgtttgtcttatttggcaatgtttacaccggaggagtagaggccattgtgtgttggtggcgtctggaaatacacaagagagtcccaggagaatgccactgtcggttcttaccacaattagcaattgtcaggtcaggggcagtgattgggtcggtgtcactctctacatggctggctctgcgtgttgaaacaccactgcctgtacctccacagatgccaaagggagtgtgggtcctaggactacagccccatttctacccagccctggctatctctccactcagatctaggtcctttctgttcaggaaaacgtcctgtttgtgtagcctgctagacagcaaaggcaagtgccaatcagctggatgatctctctgggcctcagtttccccatcttcacaatggactagtaagtgggaaccagtcaaaattggctcagagatccccaatagggttctagctccattgtgaaataaatttcaagtggagcctcgtcctgactcctgttttcacatgctcccttagagggaaggaaggtggacgattaaagatgattggtcgggagctggaggaaggaactccccattctccaagaggaggttctgttggaatagaggggcagagacttggaagtcgctgttgggcatggcccaacccacttccatgacagcagcaagaccaccaccctcaagaaggaggtgggctggggtacgagaaggtgggctgcccagtggtttctacaaaaagggatagttgtgcttgcaggaggggtagtgtctccatctcctgatgccagggagaaggaggcaggctgctggggtgacggagagcaccctcaactaggtcacactgcactccctctgtgcctcagtttccacttctgttagatggctgatatgatctctgccctgccagttggattggggcttccaaaatatcaactactgcaaaagaagaggttgtggccactgtgactcatatacatgtacatgaacgtatctgaagttttcagggctgatactgatgtgaggcaacccatgcaggcaacccggaggaactgtgtccctcactctgagacagtgagaacggactgagccggaaagctgatggccgtgagaggagcaggtttgaaaatcactgaatgaagtcatgttgtacagagggggcgggggtgcatactgtgggacggaggtgagtcacagtgcataagtgttggggagtcaccttgaacttgggccagaagagtagaaatattgagacttgggtttatctgcctcacatcaggtacatcaagttctggatggctgcccactggccagagacatgaggtggacggctcccttttgctgccctgggaaggccttctgctggcttcggccccactgagcaaagtctgcttgttcactggagttcacacagactccttgccaggcctgcccagaatcctgtctcctctgacttcctgtgctcttgcataatatttccttgctccctgaatggctggccccagtgcaggagcagctcactcacactgctggaccgagggcaggatgtagagggagggcagggatctgcaaacgtcacccaggggtgctctgggctctgagggtggagggcaagaggggcagagccccctcaaattctttggaagattatagcacaaggggagttgggaaggccctgggaccatgtgcacacacatctatctccatgaattgtctctcctgtaaaattatttttaaagttgctaagttgttttcttctgattataaaaaatatacatgttccccataaaaagtcatagtaaaagaaggcatggagataaaaataaaaatcaccaaaattccatcacccagagataaccactgttaactctttggtgaacatacttttctctatatcatgaatattgatatataattacagaatacgggcatacttctaagatattgtaggttcgttccaggccactacagtaaagtgaatatcacaataaaacgagtcacatgatttttttttgtttcctcgtgcatatgaaagttatgtttatattttagcattatgtctaaaaaacaatgtacataccctttttttttttctttttgagacacagtttcactccgttgcacagactggagtgcaatggggcaatcttagctcactgcaacttccgcctcctgggttcaagcaattctggtgcctcagcacccccgagtagctgggatttacagacatgtgctgccacacccagctaatttttgtgtttttagtagagatggggttttgccatgttggccaggctggtctcgaactactggcctcaaatgatctgcctgcctcagcctcccaaagtgttgggattacaggcatgagccaccgcacctggccaacaatgtctataccttaatttaaaaatattttattgctaaaagaaatgctaacaatcatctgagccttcagtgagtcataatcttcttactgggagaggttcttgcctccatatcggtggctgcagaactgattagtgtgacggttgctgaaggttggggtggctgtggcaattccttgaaatcagacaagaatgaagttttttacatcaatagagtcttcttttcaggaaagactctgcagcatgtgatactgtctgatagcattttacccacagtaaaacttccttcataattggtgtcaatcctctcaaaccctgccactgctttatcaacttagttgatgtaatattctaaatcctttgttgtcatttccacagtgttcacaccatctttaccaggagcaaattccatcttgagaagccacttttcttttctcatctgtaagaagctctgactcatctgttcaagttttatcatgaggttgcaacagttcagtcacatcttcaggctccacttctagttttcttgctatttcttccacatctgcagttacttcctccactaaagtcttgaacccctcaaagtcatccgtgaggtttggaattaacttcttccagactcctgttactgctgatattttgacatcctcccacaaattacaaatgctgttaatggtatctagaatggtgaactcttttcaggtggttttcaatttactttgcccagattcatctaggaatcactatctatggcagctatagccttacaaaatttcttgaataagacttggaagtcagaattactccttgatccatgggcttcagaatggatcttgtgttagcaggcatgaaaacaacattaattttgtgcgtctccatcagggctcttgagtaactaggtgcattgacaacgagcacataaacatatgtgctgtcatccaggttttgttgttccactgatagagcaccaataaagtagatttggcataatttttaagaaccctaggacttacagaatggtaaatgataagtggcttcagcttaaactcaccagctgcattagtccctagtaagagagtcagcctgtcctttgaaactagggattgacttctcccctcttgcagtgaaagtcctagatggcatgttcatccagcataaggctctttcatctacactgaaaatctgtttagtgtagccaccttcatcaatgatcttagctagatcttctaaataactggctgccgcttatgtatcagcacttgctctttcaccttgcatttttatgttatggagatgtcttctttccttaaatgtgacgaaccaacctctgctagcttcatacttttcttaatgcagcttccttaccttgctctgccttcctagaattgaagagagttagggccttgctctggattagactttggcttaagggaatattatgcctggtttgatcttctcactaagcttaatcattccttaacttttgatttaaagtgagagatgtgactcttcctttcattcgaacacatagagcccattgtagagttattaaaattggtctaatttcaatattgttgtgtctcagggaataggaaggattggggagggggagagagagatacacacacacacacacaaacacacacacgcacacagaggaacaatcactggaccagtcagaacacacacaacatttattaagatcactgtcttatatgggtgcagtttatgcctaaaaacaattacggtggtaacatcaaagatcactgatcgcagatcattataataatagctataataatgaaagtttgaaatattgcaagaatgaccaaaatgtggcacagatatgaagtgagcacatactattggaaaaatggcatggataaacttgcctgacaaaccttcaatttgtaaaaagtgcaatatctgcaaagtgcaataaagtaaggcataataaaacaaggcatgcctgtgtttcttaaccatttaacacgtgtaaaactgtgctaccatttttattaagttcccatattgtttttgtgttgctgagaaagtttttgagtgttgtaccctaacctcttctttcccgtaagctctgtggtttttagttttgcatagtgtggtgatttttaggagctcatatgccatgttgtagcagaactacttgtaaattcacatgacgtgtcttccctaaattcaacattaattattagttattaatagtattaattgtgaagcacaataaaatgaggtatgcctgcattatcatgttacatgctattgtgaaatgcattttctatatagcaatatatcagaactatctcttgctactaagttacaaagatttaatacatagttgtattaagttccacttatagaggtatcatagtgaaacccttattcattgacatgtccaggctcagaaaacaagctataaccagcccaagcttattttcagacctgaaaagcagcatcttttctatatttctgaccaatgtgttatctgaaaagcggcatcttttctatatttctgaccagtgtgttagctatggtgccccagaaatagctgcaaaataaaaggttaagtgccatgtaggcctttctctaggcttagaataattcacttgattacataggaagaggctgcaatgatgacagcttccagggctgggccagaccttaccctgggtaaaatgatcctccagtgtggcccatatgtatgctttgagccaggagctgctagctgggagaacaagtttttcttcagtggtattcctgtgaccaagatttcaaataagctccatttttaattttaattggttattgtcctcctgaaattttatgacacaatctatatctttaaaaaggcactctttcttctttatacagttgttttcatgatgttaaaaactttaaagaaagtatcattcagatttgctgacagttggaagattattttaaaaatccaactagtttagctgaaaaaggtgctatcagtgtttctgtctcatccttggaaattgtatatttttaaggcttgtgattagctttttctcctccattgctgatcgtggttggaagtgtggcatagatttacagtaaactttgatataatggtgattcctctttgttttggagccaggtgcctgcggtatttgcttattttctttgattcatttttaaattgagttgaatgtttgatttaatcagaagtgatagtatgaggctggggatgattgcttgtggttgggaattgcttgtaaagtttactgtttagtcaagacaaatcgtttcctaaagctctctttttcagatttcttgtctatgtgggaaagcatgataatgccagtcagtttaaacatatttaagagttcccaggcatcttcgaacagaaaaatttgcaacaaaatttggcaacggcagaatgcgaggatttttgcctcattttgtttatagttgtctgctcttcaggcaaatgatctattacaacaatctgaataattacagtctctccttcaatttattcaccctggactcctttttctagaattactggccagactcttattacaccaaattccttgactctattcccgaggaatgaggatgggactaggagtaaaagttaaagagagaaactaattgttgcctgcttttcaaagttttcggtgtgtggaaatttgttgattttgtaattgctcccttagttggtcattacccgattctggtagggtacttgccatgtgtacacatttagggagtgcaaagggacagtaagacttaattggtcctgggaattgttgaacaggactttgttgaaatggctacttctgtacaatgcacatggagcagctgttggcatagcaactcctacgtggaaaagtgcacgccgcttgcagatgacttttgcagtgctcagtgttaatttgataaatggcttttctaatagcagtttgtgggctaatggaaagatcgaagcaaaccttcattaacggaaaggagaatagggattttgaagccactgggtgaacacactggacagccagagctaaatctccattttcagctgtgtctctttttcacagcagatatgcttggagtgtggcagatgaaagtaaattaagaaaactgtctgcccgtgccattatcatcttagattttaagcagggagaggttttggagtcctttctattcaagatacttaactttgtgtgagagtttagtttaagagtactgtagaagctttgcattgtgttgtcgttttcctttgctggtagtggtggggttaaggtggttaaatcgttttttattgtggtaaaatatacataacaaaaaatgtttaccattttaactatttttaagcctgcaattcaatggcattaagtacgttcatattgttgggctacaagcaccactgctcaagaactttttcatcatctcaaatggaaactctgtactcattaaataataactctttattccccacatgctccaatccccgataatcactattctactttctctatgaatatgactattccaagtagattgtatatatagacatataaagtatttgtccttttatgtctggcttatttcacttagcataatgttttcaaggttcatccaagttacaacatgtattcaaagttttatttctttttaaggccgaataatatcctattgtgtgtagacactatattttgtttatctggtcttctgtcaagggacatttgagttgtttccacctttgggtgttgtgaatcatggtgaacatggtgtacaatttgagtccctgctttcagtttttttggatatagacctagaagtggaatttctggatcatatggtaattctgtgtttatttttttcaaaaactgctgtactgtcttccatagcagccataccattgtacattttcacgagcaatgcataagagttccagtttcttcatttccctgctaacacttgttattttctgttttttgttttgttttgtttttgtttttagatatcagccatcctagtgggtgtgaagtggtatctcattgtggctttgatttacattttcctaatgatcagtgatttgtctttataaacatattgcctgttccttgccccccaccccacccccgcacccccacaacagcctgtgtgggaatggaaatcactgccccattgtttacacctgtgaggcaaacaaagactatcaacataatgatatttgggagtgaaaggtgtcagggagagaaggatgaaggcaccataaggttattatatataataactggcatataggatatagtacaggcacctcagtagacctattttcagttcgtgctgtggagcatgtgaaactattttaaatagaggcctttgggacttaagtaacttcaactctctgaatgaggtttaaggcaagcttgctgtgggctggatctatcctgtataatccctactgatttgggtgatgtataggtacccttccctgaaattcttccctgagaataattattgttgtcatctactacggaatcctgggcccactttcttccttcttcttgggggaggaaatctcccagacatcttgccaagcatttgcttaagtctttgaaccgctgcactagctaatttctccacctgaaacaatatacaaacccctcctcttctccacccgctaggttcttatgctggcagctcatatttttacaagaaaaagaagttagaatgtattgagcacctgctataagcctggcactttgctagtcactgtgtggcagatgactacatcagtcatgactgataaaacataacttctatccttgtaagtgccgcaggacttatttgtgactcttaacaacaggggttccaaaccttagtgtgcatcagaactgcctggggcttattaaaactcagattactggacctcatccctagaatttcttactcggcccgcaggtctgaggtggagcctgagagtgtgcatttctaacaagttcctagatgatgatgatgttgctcatccctggaccacactatgagaaccactgctttccatcaagcctgtgaaatagatattattcccatttatagatgaggagctgagatgtagagaggccaaatgacttgcctcagttcttgcacacagagccagagcccagatttgaagctgagaggcctcactccaaagcttctgctgtttccattatatcagggatggcaaaggcatagataccacctgtgcttccctcacttagtccacccccacgacaggcaatattaatcaatcacagcacctctgagcccagagatgtcctcggaatctttcacacactgctcctgacagccaaacctacccgtcagtgggagctgaagtttgcaatttctgtactaacctgtatggcctttctaaaatggagacattaccaaggaatcaatctattaacagctgaaaacaaaccttgtgtgagctccagtcttatctgcctaggagggaagagcgtggtagattgcaggctgtgtgaagcacagcactcccatggcgacctcacggatcataactagagtctacactcagcacacaggcaacacagggccgttacccttgaaaagtgtaaaaatctagacgaagttaatgaggagactttttttttaagctgctatattttgtctaattcatatatgctacattttattctaaaaatagttattctactctttggcactaagtttggtgatggatataaaatagtgatcaataaacagttgttaagaaaggaaaaataaagtaggtgccaaaggcaactgtgtccacacctgatgaggtcttttaacaaatggatgggaggaataaacaagactgaattatgtttttatatatcttgcgcacccaacagttcttagcaaggcccgtgggcagtagatgcccaataaatatttatcatacggaactacaaatcttgcttgtgaaagtacaaagcataggtgtatcctggaggtagggaacagtaaccctgagagcagactggtttaaggccatctctggccaaaccaaaacacattacagaggctctctgagtcccaaagtcatccacagattgatgtcttgcttctcttcttatggcataagagactggtagaaaactgaccaaactcatcaagaaagtaatatttttttttcctctgaaaattgtgaattgtatcagatattgccactattatgcccctaggtcacttgctcatctgttttccacagggaagccaaaacagaattttgcaaagatatacatgagtaatcaaaggaaactgactgtattgggtgtgattctcctgtcttctgaaataacccaccatgatcttttgcgtgtttctgccagcccatacaatgtctggtctcaccaccaacaacaaatatttagtctatggctactgtgtatatagggcaacctcttgtctcatttgctgtttgtgcagcttaaaagcaagggcagggtgaattatggtttttttgtttgtttgtttttgagacggagtctcgttctgtagcccaggctggagtgcggtggtgcgatcttggctcactgcaagctccgccttctgggttcatgccattctccttcctcaccctcctgagtagctgggactacaggcacccgccaccacgcctggctaatttttttgtatttttagtagaaacagagtttcaccacgttagccaggatggtctcgatcttctgaccttgtgatctgcccacctcggcctcccaaggtgctaggattacaggtgtgagccactgcgcccagccctaattatgtttttatatgaattgcacaccccacagttcttagcaaggcccatgggcaatagatgcccaataaatatttatcatccaaaactacaaatcttgcttgtgaaaatacaaagcataggtgcatgctggaggtagggaacagtaaccctgagaacagactggtttaaggccatctctggccaaaccaagacacagttaaagggagcatttatgtccctgtttggctgtgatatgccctatagactggggcaaggctgtggcagcctggccaggatgaaaacgctcatccttgggctgcccctagatgccaaactttttccgtacaagttttcaaggcacattattaaaagcagttacgtaagtggggaactaactgcaccttataaaaggcttaacaggagagacagagtcctccatttggagctgttttgttaaatgttgagaatagagaagtccagaagtggttggtgtttctgctctacactgaaaacgaattgggctggagcccatctcacagcctgcctttctttcttctatctcacccagcttgggcacaggcttttgctatactgttggactgggcagttccccattgatagagatgttgtttaatatttaagtatgttgtgtagctcttaacatcgaaagagaagaaaaaaggtccagtttatctttagggtgagctgacctttccagatggagcagggaaatctcctgaggacaggaccctgggaggaatccacttccctgcttaaaaagcatggtgaggaaggttcccttgggcttgttggatccagtactctccagtgggcagtgctctgtatgttctaggttagagtcttagataatatgggattttaaaaccagtattgtattacattagagtattactgcccttgggaattttttagatagttccttttggggagagaactgttttgtcctatccattgcagatgggagcaagaacatacaaaagagcataaagaaaaattctgccgatgtgggcatttccttgaggctgagggactaggagaggcaccaaagggtgtccttcattcatggtaaaagccctaatagcctcagtgttagaatatcctgtaggcaggcgaaggatgacatgactcactttggtggtgacctcctagtagttcaactgagaatccaggcgggataagatcagtgcagggtaattgtatggtagctagtcaacctttccattgcttagccggagaattctggcttttgtgctggtgatgtcaggcaggtgttggaggaggagttccatgaccattttctctgttcctgccaacaggaaagctccattgggacatacacgctcacttccagggtgttttatattcatccatagctgctgcatggataaaaaatttggcgaaaaacttgaaatcctattaccatgatgatcattagaactcatgttagggctttttgtttttaaaacagggacacaaagaagaaacagaaggctgccatatgcaaggttagtgaaagccccttaccttcaccccatttaaatcctgaagagggaaagtagctaagctgtagtgatcacttcctgcaaagaaaaccataattatggcgcccagttattcttcataaggggaaaccttggaatagcatgggtgctattttgaatatttgagaaaacagtgacattcaatatgaaatggaaatgattctgtgctgctgggattggatcagttccttctaggcatcagttgcccctggggatagcctagttctccctcctgtgtgaatttgggaaacactagaatcttgtagttgttgctgactctcccaccagcagggaaccaacttatgctcttgggagaagcagggggagtggggaatctgcttttctctttaagcttccaatctcaactgcctaataacaagggaattcgactatcaagatttcctggagtggcttaagtatgggcgccaggatgcagtcttctgtacacagtgaaagaaaacgggggtaaaaaccatgatgaataggtgcagagaggagtggctagatcacctgcctgggggatgagcctcccacgtgactgtaaggttgtgcaagaattgggcaacatttggtcagggtggagaggccttgacaaagcatttgtactcccactagattcctatctcctccgtggggaaaaacaagtatttaaagttctacacagtgttttaagaggaagaaatggattgccttactaccctagcatacttcatttgtacatatttggagttctattcactaagcacccactgtaggaagggcactgggctgaagatcccagaaaattaaaggagacacctttgttcctgcccataggaaatatagtctagtgggggccaggaaggggtaagacgagcatacaggtgatcatactcaagacaggagatagtaaataccctgatatggaaatagggaaaatggttctaggggttttggagaggagaagtgagagggaggcggtaagcctgcaggccctggagccagactgcctgggttccagtccgagatttaccacctatgagttgtggtatcttggagaagtcacttaaacacattgtacctctgattcttcaactgcaaaatgtaggtcactgttgtacctatgtcagtagataatggtttactgcccataaacattggtctcagcttcaggaccagcaggggccgtgctgaccttgagctagtgacttacaacctccaggtctcagtttcctcatctgtacaatgaagagattagactggataaatgctaacattttctttattctaaagtgccgtgatttcatggttgaatatgtattaaatgcctgctgtgtgcccaatattgtgttggcataatgaaaaagagaaaaagtaggatatgtggtccctggcctcaaggagctataatctaagtgaggagaggacattaatatacaggagagtattagagaattagagaatattagaaattaaaagctaggtggtatgggcagtgagaacataggaatagagattttagaatggaccagagtagtcaggagatttgatagtgacctatctaatgtttagaaccacagagactttagacaggagctcagacttgtttacaaatcccatgaattctgaagcttggaacactgccattaatatttaaattaaagttgaactgcagaaaaacaaaagttacctatttggaatataaggtgggacaaagtttataaaactccatgtctaaaaccggtagtgtggatggaagctataaagaggctcaaaccagcttcccatatatccttggatgacaattccattagaatatagcccctggcacagagtaggcacacacaaaaattcatctgttgagtgacttgtggaaaaagtgttctgccctgttcagctttgaacagctgtgggcaccctggtggtggtctcagccccacctccagagggcagtgcacagaggaggccccgccagagccctcctgccaagtctttgggaagagcttaatattgcctcatgcctcctgagccagccctctatcaaaggtgaattctctgctcccaaatgttaacctacctccgggggggctacacgtactccctccccagaattgtctgaacttaggttttgagaaaacttggcaacagcctcaaatttttcttccagtctaactatcctatggtccccagagtccatatgcagatcgggctgttagtgaccctggcttacacaggtaaaaaagagacttaacaaaacttggcagagactgctaagtgccaaaagagtggtgtagacagtaagtgaggtcaccccggccaggaaattgggggcacctcctggaaggagggagagctaggagcttgagtgggtcttgaagaatgagtagaggccacgatggcaggtaagacaggtggaggcattaagtacttctgtccccatgaccagttcccccataccactcttcgttaaccaaacatgggaggtggcaggcccatttagatctggtgctttattctaagggaggaaatgagatgaaaatgacagatgaagtgcaagcttgaactccctggcctcaaccagtcactgagaatggctgcccatcccccaaacagtcagtgatggcctggtttgatgggcctgtttatgacctcctggcttgagagcagcagaccacaaaccttcacagagctctctgttgaatttccttcccagtacagaacccagaagtcctagttataaatgtcactacactttatttatgtagcatcctctgtgaaaacatgagtatatatcatatctaccatcagaacgtaccttcagcaatcacttagaacagtggggaggacagatggggtcttcaaggttcagaaaggtgaaatgtacaatatcttcccattgtaactcttcagagcaaatcagaggtgaaaatgttcagaacacaagtctgccttccaggccagtcttctaagcacctttttcttctctttcacattttacccttgtctcattccctgttccctcctcctttttgttcataaaaaaaattatttttttccaaataagcaaaatggagtcaaactttgcatcctcaaaatgtatgaagtaaacattattcctaatgagcctctgggaaagtgctcacctttgaacttggccaaggattatgcagcaaagaaaaagtcttaagaacttgatagagtgttagagcttcctgggtttttaaagtcaagttgcatattacatttcttttccttaataggggcatttccagaaacccttcctggttgagtaggccagtgtctgaaagtgaagcgctaggattggttactgactctggttcagggattgtcatctgggtgcgaggcaaccacagggtaggaggcaccattgctagaatgctctttctttcctaggactcagcacctatgccgacagtccttgcaagacaggaggggaacgtgtaggctatcctatttatggtaaggggaggcctatggaaaaacaggaagatggtcaagggaagctggcagcaaaaaggcaatgagaccgaggagttgtccctgtaagataagctcttttccccttggagaccttgcctattaattggcctgtgctcatctctataggctttctattaaaacacacacacggccaggcgtggtggctcgcgcctgtaatcccagcactttaggaggccgaggcgggtggatcatgaggtcaggagtccgagactagcctggccgagatagtgaaaccccgtctctactaaaaatacacaatttagccaggtgcagtggtgggcacctgtaatcccagctacttgggaggctgaggcgggagaatcgcttgaacccgggaggcggaagttgcagtgagccgagatcacaccactgcactctgggtgacagagcaagactccatctcaaaacaagcaaacagacaaacaaaacacacacacacatccttcttaaagacaaaaacacctctggctgtctgcatagcttctgcctgcctctgtggaatattacacattttaaattccccaactattgcctcacagccaagaagttcacttataggcattgagatgaatcattcacagaatgacttaaatccaactaagaatgtgtaactgctgaacattctgattgaggttccagaccgtttgtgatgccacatgtttgttgtaacaggcagaatcatcagtaatactttgtttctcttttcttgaaactttccctccaagtttccatcttaatgctttaaatcatgacagaatcaaacaagctctgtgccctctgcccctgacccccgtgatggcatgagcttcaccaagcacccccattcccacagagatctgggataaaaggctttacagaatccagaatccagctccgtttctgagctgttatcgcttcatagcacaggctgtctttttctcttcctacacgtagagctaggcacacatagatgggtagtgcactgtccctgaactgaggctctctcaagtccaggctaccttctgcccagcacctacttagtgtagcttatcttttaaaataagccatcctgcaaagagcagggttcccagtggccttgaggtttgtcagaagttctctagaattggcaacttagctgtgacctcagaagtcttggctctggcaaagcaaggtctttgcgctaaaacaggctcagtgcccatggagataatcacctcttgtaatatccacacaatcatctcattgtcaaagcacaaggaatgcaaaaatagaagaaatgccacaatagggttgccccatggttcagctaaaccaggattctgcttccggctgagggcaccttgggacaccttaggagggatggtcccaagcattgttctggagttcagcccctgttggcaagacctgtcctcctacaaccatagcctcacggggcctgattttgccccatctttttgggactcctttaccacctccttgtcctggctaactctcctttgtccttaaattcacaactggggaaacccttgaggagtctttttttttttcctccccattttgggttatgtcatctttcttgctcccagagcacttgctcctgacttctgtagcaatggcctcaacactattgagtgtgtagtatttcttaggcatggttctctgcatacatgtatatattatttattcctcacagaggctctgtaaggcaggcactcatagacgctgaggtttagagaaacttaagtaacttgccccaggtcatagagtaagtgtccaagtcctcaagcccgggcagtcctgctgcatctgcatggcacatgcgcttggcctggtctgctcagtgtgtctccctgactgggctgtcagttcctggagggtagggatctgtcttcccttctctatccccagtgcctggcatgtagtagacactcagtaactgtcaaataaatgaaagccctggctcatcaaacaaagaccagatgtgatttaaattccaaggagccatactttttacaaaaatgctaaaatgccaagaagtactttttcattaaaacaaaacaaaactgttttagctatgtaagggtggccttttagaactctgactgctttagatctttcctctaggtggcatagagttgtggggtttggcagaccaccatgggaaaagaacagatgcatttgtcagaatctctgtggccatcagacgtcactccaatgaagccaaagctccgaggtttaaaaataattaagggaaataactaagcggagagacagaaaagaccacttcttagttgattctggaaaaatgaaccttttctttctaccaaccggcaccgaaattcagagtatcctggacacagctgagagactactcagggagagccactgcagtcacaccccacctccacttaggtctccctacactcactctaatcttctaaatcgtttaatcagacacggcgctgcctctgaggcttcaggactttcaggctgtttttttttccccgggcttaaagtctttctctgctgctgactcacatgttaattattgctttgcataaagtagaattagcagtgctcctgcactcacctgcctgcgtgttatacaactgttttatctgctggacagaactgagtgtgcaggccggcctgccatggtgtcaccagcggccctgtcttcagctgccagggcaatgagcatcgcacagaaaccaaccattgctttagaggctctggggaagaggctgtggggtgtgctctgcttgtcccaggaaaaagagggttaagtgccaagttttgaccaaaatcttataagaatggtccaggagtttcagttccctgtcacctgtcagtgttaatggacagaactggtgtttcacagaaaaaaaaaaaaaaatacgtgtgtgtgtgtgtgtgtgtgtgtgtgtgtgtgtgtgtgtgtatcaacttgttttctctttggctgctgggctggataatgaagtaaagatgacattatctctaataaaagtgatttgcagaaatcactgacgggacctcagtagcagagattcgccattagcaggctagccagataagaggggcagctgggttctgttaaccccctcctcgtctgatgtgtgtcttgcagggaagtcaaaggcggaggagtagagtagagtggactttttgaagtttgggctaatggacagtgttttttccaaagtgtgggctgttctttagccccacttgctgatctttagggatgtcattaggttttcatttttgttttgtttcttaggatttttgtgttagtggctttttccccctggggcttggcccattttctcacctctatgttatatcaccagaagggtggaaccctggccaagccctggcatcctctgccagaaatctgagtccaagcagggcacctacacatgtgaggtgagggctctgggccacgggtgttgggcaacagattgttctgtagtgtcgaggaggtgggatctgaggcagaaacctccctggcctcttaaggatgggacgggtcaggaggggaggggtctgcccttgtccggacttgttcacctgtgtcagtgagagctgactagcagctggctcacgaaacacacccatgatgtggacagcgggcacagccagctacttctgtgtgaaaacatccttagtatacagggatttgtttcctggggacagtgaggagtcatggggtgttaagcaacctagtgatgaatatagccaccatcactcgcctttattaatccactttctactggaagcactaaagcattggaactctgcaatacccccacagctgggggaccgtgactgatttaatcttcatgccagctcaccataccataactgaaagggctgtatgacactattattgttggagtaaggtactttgatacatgagaggtttgacattttgcctgtgccctcagagaaccttaaaactaggactaacaaggtgacggtgccttgcagtcaagtagcacagattgtctaagtgttccaggcaggagtgaggaggagacaccagtgtaggctcggtaagatgctcagaaaagcctctgtggaggtggcaggcctatgttggctctcaaactttagggtttagaaggtcagaaaggaagaagcacttcaggtggaacaaatcaactggggacatggctgggcagcagaaaggggtgcggagtttgggggtggcagggcatagtgtggtctggctggagtaagcgtggagctacaggatcgtaggagctaagtttggaaagggctgggagacctcaaggagcacgtccagcttggacttcatcatgaggatggtggggagcaattttcattttaaaatgggggagcgacaagctgaaaatggttttggggaaagagtggtgggctggcgagctgttccttgccccaagatctgactcaaattttattcttggtcagtggtaaagaaagtgaggggcaagggaaacaaacagaagatggggactaaggtctgtggaaataaataaaacaccaccagagccagaggaggcgtgtgccctgggtgaagtttgtttttcatcccatgggtaacatttatgagttactgttcagcaagaatgccttgcggaggtctctgtggactgagctgaggctccagcctgtggcagcccaggaattgctgccatatttagagcttccaacagagggtttcattttccttggctttggtgccaagaaaagaggggttctcacacttgctgtccagcagggccaaagcatgaccagcaggaggagcatggaggttgggttctggcactgcccaccacctggcacctcagccactaatcagacaacaggctaggcaattatccgggcatctgactttagctacctgtccttttgtttaaagccctttcgtgtgcttggcaccttatggatactcaacaaggtctgtttaatgaatgcgttctccccacccagattctcaatgccttgctccctgttctctagcctgtctcccgaccactggcacctctgcccattcccagtgtgtctttgtcatccctctgccatcctgattgcctccctgtatcctgctcttctttcaaagccaacctccagcagagttctccctgtcttctccagccttgcaggctttctcctcccaaactcctacagccctgactgttcagcccattcttcaggacttggctcttcacctctctgcaagctccctgaggtcaggcatagttgttccacatttcattctactgctcacagccccatcgtaggaagagagaatcattaatatatattgaatgagcagagggaataagccattgctgggggaaaaatacagttttatttcccaaattgctcaatgttatttgagagcatgataataaatttggaaaagacttttagcatttcctgtggcttttgatgacttctttacaaaggaatggaaatgtgcgcagacatctcacttctcatcagagcaagagagggcagaattgggggaaagcaagtgttcgcgctgtggcatgaatcagatcccacaatactagacatgtgaccatgtgaacaggcctcagatcaggattctttataaaggaagcccaggacagattctctaccagctctctcctctttcacttttcctctttctttgctttcctttttttaatagggaggggagaaggggttatgaggatgggggtaggagagtgagggatcccgtgctttctcccccttctcttgctgttttgaaatactttaaattccaggaaccagaagttctggcaacatgttgggattagtaaggcagatcctaggatatttcactattagcatgtgatcaagcatcagtcctgattaaaagtctaaacaaatgttttctttgaaattaaagtgtctgaaataaagaagagagaactgacccttaaaatcatattctgtacttgaaaagagttctgacaactgtctgtcccggttatgtgcacccccgccccccacccgcctttttccatccagaatgtttgacgacactgccaggggaatttctgccccctccttcctgtatatacccagtgctggcctctgaggcagtccagctctgttttctcatgacacagtgattatttttggcattgcagatattttttctaatgttattacccagcccccttcttggttgccttttgtggagcaatcttttgggtaactccctgtaaatttgagggttaattttagttcggtgtggtagaggaggcagtgggagagaggaggaacgacttctactccgaagcgccccacccccaccttaagaggagccggagaggtcctctcacgccctgctcatgaaagagcttgctttcaccagctctgtgctcaccattcatcctttctgccggcgggcttgaggatatggatatccagaggtgacgctgggggctgcacctcggggatggcatcttaatgacttgacttggcgggtgttagaacagccccattcagagtgagttcactccctgcgcagttggctcactcggcctctgtccatagagttctcttgttcacgctgcaggaggaaatggagatttccaagtgggaaggagccttcccgatgctttaactcttcactgaagggaagaggagctgcagagagcgaaataaaatctaagccgccccagctgcagcgcctgggagaggagcaaggctgggctggggatggaggccaaggcagctgggatcactttttctttcctccttgagagggaaaggaaaagagcaaagggcatttttgattgtctttcacaatcagcaaatatttacccagtttgtctgccctagcccaggttccactgaaggatacacgaaagtggaagatgttgtgtctgtgcccttcccctggtacttacagcacagttataggagtagaacgtttgcatagaaaagccaccaagacagggaggcctttaataagggcctatgagtagtgtgggcaggaagtaccctggagaatgttgctaaggggccagggacactgctggaagaagtagggcttgggctggtcctaaggggtgggttttgaagaaataggaaggaataaaatgatacaggtagggaagacttgaaggaggagagggacattaatgtagggcttagtaaaatcccataaagaaagctacaaagagaacaggattcttcctggccagagagaagattggacttgttggactttacgtgcctcagattaggatggcagcaggcagcactaaccctgccagatggcatcttcagtctcaagatcgcacgtgttcctgggtctctttctactcaaagtgtgaggtcacagactagtagaatcagcatcctctgagggttgttaggaaggcagaatcccaggcttcagcccagatcctactgagcctgcactgtaacaagatccctgggtgattcctggccacagcaaaggttgggaagtgctgctctgggtgactccacaggcagctgtcagcagcactagttcagaccccagatttgattcacagaggtgacaaaacaccaacagacacacacaccttgagtgtccgcagggtgactcttcccagatggaaaccgtctattctaattaagagccgggttagaattcttaggaaagatctagaacagtgagcagctttgaggaatccacagaactgaagtcattgacgtggtttttatccgatgtctccagtttgtaccactttgtactactgatgctttagaggacaccaaaagaacaggtgtggggttctttccctgaagagtatgtggtctagttagggagacagaagccacagaagtgaaatcaaggagagcaacacagggccaaatcgtgcgtgtgtaacctctgaaatgggacttggaggagaagtcagtgcaggtgaggctttcctagggaaacggatgcatgggagatcttgaaatatgagcctaattcagacaggcctgggagatggagagagtatattccaggcagggagtgggaggggcagcagcagtagctaagtcccccctagagactgaagtggggcgggaaactgctccccacttgccccacggagtttgcttcatgccgaggaatccgttttacatctcaggccttttcttcttgattcaaccgccgtgcaatttctttgtcaattttcttagctgaaggcagtgttgtaggaacaggatggcagcacaggcagaagggtttgagccaaaccacagatggtgttgttggaagcttgtgagatccaaaggaagaaggctgctgatgggtagaagccctaaggaaaaaaatctaaatcagatctggtaacagcctgggtgtggggaaataccttcaagcccagagaggtggcaccaaagaaaacagtctggtgagaaggaaacaacctgtggcagctgtagactccgcaagcaaagcacaaaccttttttttttctttttcttttaaagacagacttctccaagctgagaactatcccaagggggctggtgtgccagctgaggggctggcctcaggcaaaatggtggccagcgtgtctcactttgctgcttcccagaccaagtgtatgtttcaaaaagctcatcagatttagtatcctagaaggcttcaccctcaagatgcccagctcagctaaatcttttgaacctgagggacttgcttattggccttgtagggaaggtcacccaattacaatcaagaatatgggatttagggtcaaatgatccaggtttgagtgctggctccatcactgggtgatggctgggcatgccactaacatccttggggtctgtctccttatgtgtaaaatgggagtgatacacctgctctgcaagattgattcaggattaaacagaagcaatatgctgagagttctttactaactggaaagagtcacatgtggttgtttcctagttatatagtcagtatctcagcttgcggaggttaattagtctcttagctgaaggctgcatggtgtcaggggtcgggcagtggcagacatcagaggccacagagagcaatggagagccacgcaaatgcctcctgcacccgctggctttctccctgctttttcatgagtgaagacagcaccgagtcttctctatacatccctgcagtggataagatgaggggtgggaaagatggaaagaacactttatttttacagtgggggaagaggtcctgctcatcagcaagggtggccctcttctcagaactggattagagtcaaaggaagccaccagttttagcacagctggtcttctcttcagatgctttgacctgcgtatgcatgaggaagagaagcagcctagagagagctggccatgggaaaaggaggctgagcctggttccaaggctgagactgttgcatgttctgtcttccttccctctgatactgccctctgaagcaccgtgacccatgctttgtgctcagtaatgctggctgtggtcctgaggatgccagtgtagccaaatctgccaactcagctttcatggggtgggggtggggtcactgtgaggtggctacggggagctggcagcaagctggatacatatcttttattgtaagaagtaagcaatacctgatgccaaggtagttgtcatggcattatttataacagctaaaaattagaaaccataacgaaaagcaataagggaatagtaaaatgcattgtggttcagccacatgatgtgatattgctggctattatgaatattttgaaagaattcttaatgggatatcctgttaagtaaaaagagcaaagtattaatttataaatccaatgagatctcagctcgttttcttcatacctttttgtatttttgaagttgcttatactaaatatgcattacccttatcttcaccacggcatttttaaaaaggaaattatgtgttgggaaaagctaggttatatgatggacagataatgaaggtctgtttctaatcgtgccacatggccagtgctgcttgtcagcaggcgctctgttcacagggccttgaaaaagccagaactcggggcttttgttccagttccacatactcccattacctttctaaacctcagtttttccttatctctaaaatgggaatgatggtagctgctcttcctagcctactgtgtgaaatttacaaatttagttacagatttccagattcactcacgagtgttttagactgtagtgtgtgatccaaatgtaaagtggtattattcactaatatgtagaataaagaatgccccactgtcttagcccatttgggcagctacaacaagataccgtaaactgagtggcttataaacaacagagtttcatttctcatggttctggatgctgggaagtccagtgtccaggtgccagcagattcagtgtctggtaagggcccactttctggttcatagctgtgtctccacatggtggaaggggtgagagggttcccctgggcctcctttgcgagtgcactaatcccattcatgaggacttcactgtcatgagttaatcacctcccaacggttccaccttcagataccatcacattgggagtggggatttcaacataagtattttgaggggacgtaaacattcagaccttggcacccactaaggcttgggcttgatgaagctaagcacagggacagttcattatgattattcctgtgtacacacagcttttcccagctgggctggggagtccacgtgtcctccggttacgtaaggagctgggttatctggagccccagatgggctgcttagtaatcgaatctgctgctcttttctacaaggctgcctggggctgagaaggccagaagataagtatctccagtcaacccaagcagaattgaccattagagggccatgctgggtgagccccagacattactgtcagcgctgaatgcagtccaggccctctgctccagggacacagaccgttagagtaggtcagagagctggaggctcagccccagcggagcggaggttgggaggctgaggtatgagatgctttccaggattcctctttcagggaagtggcaagtgaaagcatttgtccctgttttaaccactccagtctcatgtcttctctcttctttgtcccctcttgtagacttttgatatactagtgtggattattagtcttatctcccagatgggctgtggtctctttcaggatagagaccatgcccctcaggagaggtgtgtgtattaaagcatattaatgccttttttctcttgtcaaagtctgtctgatctggccagctcctcctgaatttgctaatttaatattttccattctgaatttgtaactttttgttgttttgctttgagatgggttctcactctgtcacctgagctggagtgcagtggtgcatggctcactgcagcctcgagctcccaggtcaagggatcctcctgcctcagcctcttgagtagctgggaccaccggtgtgtgccaccgtgcccagctaatttctaacttttttagagatggggtcttgctgtgttgcccagctggtctcaaactcctgggctcaagcaatcctcctgcctcagtctcccaaagtgctgtgattataggcatgagtcactgtgcctggcctattttctgttttcactatctaacattgatacctttcctccctttgtgatagattcccctactgatccctgcagcctttggacatcagaatgtacctagaacactgaccactggaacactgccttcatctcaaacatttttgtcactcctttggaatggccctcacagccaagaccattcttttcaataccttcaattgtggcaaagtcttatcttttgagggcacattttatcctatcaaacaaccacaatccatccacagctaagtctggtgactaacggggtgggtaaactggataatattgtttggggtttgaaatgaggtgtgtcctttgaagagttgtgactgattttcttatgtggctctgaagttaattctaaaagacttcccaaaagacagagcgatggccacctaccagcataaagttataggcttctcccaaggtggcttctttgaagggtagccaccttctgtgtggcatctatttcacatgtctcattattttcatctccctcttcctattagccatagcatctggtacagtggtgatcacaccaactcctagataaatgactgtttggcttatgatggtgacttcaaatttgctggacacagtgaatatggacacagtgcatggtagagggaaagagtgtggttaggttttggaagtggacctgggcgtcagtcttccatagacacatgatcacaggcctggaaatctatgttttcataagtcctccaggtgattctgatgcaagctaaaattgagacccacggctctgcaaaactggggccaataacactgcatcatttaagtgaggatcaaatgagaccatttattaaatgcatctggccccagtgctcaataaatatgtttccttttcatcctactctttgagaaaggtgacatagctgtttgcatctccaaaaacatttaagtccaaccccatctgcctccccccaccacacacacacccacccatccatccttcctttaaaaactggctgctttggaaccgtggtcctcagccctggctacacgtggggagcttttaaaactcccattgcccagcctgcacctgagacctattaaatctgaatctctggggatagagcccaggcatctgttttttaaggttcctctggtgactccagtgagcagcaaaactgagaaccaccgactttggttctgccccagttaagtatggggaccagtgactctttctcatctctggaacctggagctgggtgtgtttctcctatcaggcagcccctgtacagcagccacaagcctcatagaagtgtcactagacctctcccaattgcatttgacctttatttcctccattctcagcttcttgcaaattggctccagcttggaatttcaccaccaaccaatagactgatcccagctggcttaattagcctcagtcatctctttacctgctgaaatccattctgtttctaagccatttaaccttatagggtaataggcatattgttttgatacctgaatggccacaggcattaggcatgtgagtcctaatcactctaaaagtctagctaattaggcagccaacccctctgtgttactggtgacagacatcttggggcctcactccaggctgtgttcatatggaagtcaggaaccaagatcatcttgaccaagagcagatcatccttagattcatgacctaagtagcgatccctaagccatgctcggagcaatgacctaaaagttaagatgtttttaagataacgaagctctgggcaaagaggtttttcctggatgaactgtagcatatctctgctgacaatttttggacatttcagttttgttttatcttttgactggctgcctggtgcttaagtggttgttaactttagctgggatcaaacgtttcagaatgtgagtttccacctcggggagagtaactataaatttgtgcatatgaaaatgtccagggggaaaaaaaacaaacccaaaacaaacccaaaacaaaaagaaacacctttttctccacctgcggcatagatagatactgtggcagggttggacctgctgcttttatggaacactgcagagccacatctgataacattcccccaccctcccagcactactgtgaccggcacctgtgtctgctaaggcccacagcacttagtcccttcttcccccgccgaccccatctgaactctgatgctggttcttagtcctactcttaacattccaggtgttctcctaaggtgaatgggtgcacacttaaagacatgaggctcccctcatgaaatttttgtcactgtatttaaaaaagtattagcccttcttcccaaagtatgtgtgagcatccaggttgtgggaaagtatcaacacagcacagggaacatcaaagttgtacagtaaatgatagtctccttgctgccaatggaaaaacttttgatcttggacccagaagaactaggtttgagacaatgtttttagcaaattatttaatctctctaaatctccacatcctcatctattaaatggagatgatagtttctatctctcagggttgtgagaatcaaatgagataacacatgttaagaagaagtgctttctgtaaaggcattattatttgtccttttaggttcagctgaaatcccacctccctgacttttgaaccaagaggctgcctaagattctcaatcttcctttttctggaagctaaggtgttgctgtttctttatttcttgccaaagccactatctcctacagttaagcagtgaaaagagtattcgcctaggaagagcagggttctagccctagctctgccactgattagctgggttgctctaggcaagtaacttacctgctcaagtgtctgtttccagatctgtgaaaggggaacagtgacagtacctgtcttgcctacctcacttggttgcaaggatggaattagatagggatcccctgtgtgtttccggacttctaagtgtctgctcactgactataaacccttaaatggcttatgtaggcattggctttgtgacattgggcaaatgacatattatttctgagcgtcagtttccacatctctaaactgtgtaaacaatacctactttattttgttgttaggaagagtataatgaactaatatatgaaaggtttttgatagagcaccaggcacaaaaagcacagcaagactcatatatcagatgccattgtcagagcattgactccagattgccttttccctacctggcttttcctctctgcctcttcttcgaggaaggggccaatggcagagggaagctttgtgcatgcagatattggcgttaatgccatagcctgtgctgggattgcttttgcttcaggatggcttcccttggcccctgatgacgaggttatgtgttgatgatgcttttgttggagagcacaagggttagtaatgaaatccagcatctttcacctgaccctcctgatccaaaggcatgatgtgtgcggtttcagcatcctgccctcttcccatcttcctttcctgtgccagaatacttgcaattctttaactttttctccacaatcaggtcaggattaaaatgcacgtgggagggactaatataaaaactgccactaaaggtctaatcagggcaagtcctgagaaggtggggaaaggggggtgcaggggtaggtgtcctgaaggttggaagtcagggagagagggaaacagggattagataaaggaagcagagaagggagacatgacgagaaaaatagtttcactcatttcacaatttttctgaaggttcttcttgaccatcaacagctgttggacgattcatcctttaatccgagtatatgatgcttaatccatccacggagctggatagtctgtctttttaaatgaagtatgttgtaaaatcaaaacagtgcttctgccccaaatcttgagggatttgagaggcatgctcacattccatgaatcccaaaatacagattttctgtccaaatagcaggctgcaaagccaaacaaaaggagaagcagcctctgggatctcagatggcaggacagaacgagccagctagagctgattggattgaggccttgaaacctatgaacttcgctggatgcttttttattttatcttatttatatttttatagagacagggtctcactatattgcccgggctggtcttgaactcctgggcccaggtgattctcccatctgggactacaggtccaaatactaccatgcctggcttagatgctttttaaaaaaataaaaaacatacttgtttcttcattaaatacgcaatataggttatttatagaaacacaagaaaatacagataagcattacaaagcaaaacaaaaaccaaaaaaactccctttaacctcactaccatgcaactgctaacatttttgagtagaaggagacaggacagtcattggtggttaagtgccatgattctggggcccaccttcccagtgcaaagcccgacttccccatttacctgctggaggccacaggtaaattacttggcctctatggggcagtttcctcatatgtaaattaggtataataataataataataatgcctacttccaagggcagttgtgtgagtttaaataagccaaggtagtactgcttaaaacagtccttgtaagcactatgtctgtgatacctataataatagttattatgcatctagcctttctcctatataatttataggaagtattatgtataatacatttctgtgaaaatagaattgtcctgtactgttttgtaactttttaactcttatgattgtcttttcatggccatctttttaattagtattagctaacattgattgcttacagttggaacaggcttagtgctaaagattttacataaattatcacatttagtcctcacagttaactctgtagggtaagcactattgttaccattttacagatgaggagactgaggctaagcagtttaaatgatttatttacagagctaacaagcagagaagttagaactccaatctaaacattctggcttttaaatattgcccgtgctagaacttgccatggactttataagaaagtccaggatttctttaggacttctaaaagaggcaggcttcagtgcgtgtcatctttcgttccatcctgcagcaaagaggagaatgaggctgagacagcctggcaacctatgctggcagggcttagagagaaaatgtttgtgcccactcctttttaatccttgacagaacgcacgttggtactctagactgttgggtgtctggctaactgttctggggctgtaatggcattttcagtttttactgtggaaatcactttctggtatgaagcgggatctagggttcagtactactcttaattttttctgattgtgtcttatgcagaaaaagaaccttaaagcagtttttttatcttgttctccagagcccttgacaaagccatctgagccactgatcatagcttccttacccttctctttccatccctggacattcacccctatccccagatattccagggctaggtcccaggcattggtagttaatttaatcagccagtctttgcccagactccacccatgtgaagccctgttctggcctccacagggaatgcaagaggaggactttggttgtgaagacaccaacacacacaaaagcagagctaacaatacaaagcaggttgtgtgtggctcagacaactggtgtgagcccagatcagtctagtaagggagtgtggctgcactgggggttggggccatggggatgtcctggccagaggtatgataggctgacagtaacctttccgggactaaccccttcttctccacttaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcaggtaaggccagcaggctcccctaggctgggcagatgccagccttaccagcatgttcctatatgcaggggacccttctgctgccagagctggaaagtcaccccactacagaactttcacccacagaaacaccatcatgagtgatttattccttcatgttaaacatctctcttccagcagtgacctttaccgtgaatccagctgtgagaggagggcagggacaggaccagggaagaacatgggcacccagaggctgtggagaacacgggctgggagaaccaaggacggcttttgctgacttctcaatttgttgccatctggccataagacccatcctccacactagattgagtccgcaggaagcattctaatccttaacttccagtgccttctccagaacagcaagaaggtgtgcccggatgatcttttccctctgagaagccagttaggccaagtaaatcatttagtctctctgaacattggtttcctcgtgtataaaatggggttaaacatacttcttgcccagggtgtcggtgagaatggactgaaatgatgtccataaagcacctggcctggctgagctcactcacactggggagtccttgacatcacccctccctcggaaaataactggttctcccctccctagcacctctgcaactccaaagttcacaagacatttgctttttctcagttacattcttcaagaaaccatttcctatgcgtcctgaccagaaacaggtgtcttgagtagtcttctggtttcagatcctaggtgacattctcgtcaggggtgtcagttctgtaaggacgctgggcaacgagttgtgctcctccccacctggtctggtgccacaggtggggacagtgtctgacgggtgagcatgagggaggcactcagggagggaaggttcttttgtggttgtttttcagttttccggagtaagcctggtgccttggagacggtggactccgccatcctgttatgaagtggctattctgggaaagagggaatccagtgtgaggctgggaggccagaccagaatgtactattctggtccctgtagtacaggaaggatatgggggacagactttcagaaaataggacgacagctcagtgggcctggggttggagggctaggcctaaagaggcgaaatgtgcagacaagagcaggagagccaagggggaagatatgctccataaatactttcaaagaacaatgcaagacaatggcagatacatgatcctagatgctgcaaagagagaacagtgggctgagccctggcaaggcttggattgctggatataagaaaggctgggagactccatcacagggcatttgtgtacccctccctttaaaaaggcttgtcttactggataactgagggccaagttggctaatgttgcaatcatctttacataaaaagagtagacagtggaggatttaatgactggatggaggccccttccccacagtgagaaccctctcccctgctttcctgctgtggtacttgagattttgctcttagacattaattcctttggattaatcattgcttctttcatcaccactcccaattcctccacccacacaaagccccagaaggggtaatacaggttgagtatcccttatccgaaatgcttgggagcagaagtgcttttgattttttaattttttcagattttggaatgcttgcattgtatttatcagttgagcatccctaacccaaaaatctgaaatttgaaatggtccaatgagcatttcctttgaatgttgtgttggattttggagcatttcagatttcaggttttcagattagggacagtcaacctgtatattaattgtagaatgcctctgactaaatttggactcgttgtgtttctccttatttcacagataagtgaagcacagacaggttaagattgctcaaagtcacacatttagcacatggtgaacctgcacctggaattcaagtccttttgaattttggtccatgggaaaacagacatgggacagcaagagcattttgtaaacctggtcaggcaaagatgctgacaagggctggggtatggggtgtgggggaagggagaaggtaggggaacaaaggtcaacagaagcagctgggggccagcgtgatggggaggaggtcctcacacattcagagagttgtcctgtccttccccctagtgcagggcttcgttttgcatgcttgccctcctgagcctggctgtccatctcagtggttcaaaggttggcctcgaaaaggccacgagttaggctggactccctgagcacatctacctgtgtgtgttctggtgtgagccctcatgtgctgatgggaacccctgtgtgctaaacacacccacagagataggaccagagtggccacagtgggacatcccatatctatcccatctccggagcctgttgaaagttgtggacacaaacttgcctgccctctggctgggctcggccctagaccagctagagcctttagcctgtcagctctggtcctctctgtcccaaggaaagaaatgaaggaaaaggataaaaagtttctacttttggccatgtggtcctgatgtccttgaaggagaaattctcaccaaacgagcacagcccagggaggaggagatggtttctcagcacccgcttttctctgacttctctcccaggctcctgccacacattcgctagactgattgttaagttattttcagaaattgtaagacaagatctttttctttctaaatcgtattttgcttttccaacacatgtagcgttatgaagaggagtacgggatttgtgggcagatagacctgcattggaatcttagtttggctgccttctttctctgcaatgtagtaaaaatttctctttgagctttagtttcctcatctgcacaaagggaataatggtgcttaccctgcaatgttatttggggattgagataacagatataaaaggccttatcctctagcctgccacatattaagctctcaataagttatagcttagaaataaaaattattatgaacaaatatattgatttatattaaatataggcttctggagaaatgatgtaaaagaaaacccagtgtaaattcttactatcctctaacctactttctagcaatttctatcaaaatgcagagtcgtcaaacttttccaaggcaaaacaacccacacattcattatttaagcatttctaacaaaggtgagtaccaattttggctcactttataataggaaatagctggttgcatacctcaaagttcaaaaggctaaaaaataccaggtttttctttagaaaagtttctctttacttagtaacacgtttccctttgattttcacagtaggctgttctgtgtgggaatgttggagaggaaacctcaacgttgagaaattcaggctgtgggtctgggctgccgattgagattcgtatcacaggaagcaaactgaaacaatagctttatgatattagctgccacgctgggctgaggacagaacacactcttacaggaacatcggtggaaatgccacttgattgtcctaaatcctctttcaagatgagccccacaaaccatgagcgaatcagggtcaactctgcattctgagggcattaaaccgcagtgaatatacaaaatttgcttttcattgtaaaactgaattttgggcttgcccaaactcatacatggcgaaatcaaattcattttccatggacctggagatcagcgtgaagcaaggtttctaaagagaagtgtcagttgcattatggattcatcatcatttgcttagcgaagacatcagttataacaagagattatattttcctgatctctagactactaagggaaggatattaaaatgtgagacaagtgattttaaagtttttaaggcttgatatgacctttccatgcaggaaaagtgggacaaagaaagaattgtggaggcagatatatgttctggtaccctctcacaccccactttcagacttcttttcccaggctttcactcctacctccacccctttgtcccacccactccaaatcaaggcctttttctgtcctgtttggaaagaactcaataagctgattcatgtgaggatgttaatgggtgagaacagctaatatacagtctcttctagagatactgactttgttcagatcattcctttaacttaaactaaaaagtctcgtcagtcaacaggtgtttgctgaacccagtcctgtactacatcaagggtaatacagagaggcaagataggatagtaagatacatgcaaagaacaaaggcatgaatctctcctagtggactttcaggactctcagggagcccaggaagatcaggaaggacacagtgccttctgtcaaaggcatcagaggagcccaggcctgctaatggtggcatttaaaggtatggctaaggatccagtaagcgatcccagagtgatttccctgtggcttgactggcactgctcttgcagtctgcacatccgggagggcggggtttgaggggccaggctgtgggtcaggtggaggggaggaatcagtttaggcagagccttagaaggaaggcccctgtggtggtcacaaagtggtaactgccaagcacatctgaaccaggaagaccccatcagaatggctttaagaacagtcagagcagtcctggaacttctcggagtaggaaacaagaggcaaagcgaccttggtggaataaaagtgcagccagcattctgaccagcagcaccgtggggcagcctggtctctgagaccactcaggagcctctgctctgccactctgcctgctctctcccaatgcacagcccctgctgcccaggaagtcccaccccacatgggcggtgctgcctgaaggaaatgagcgttgctccggaaaaagtgctccaaaacctcagcccgcgcatatcctggctgtggggagtcatcaaagcctgtttaccggggctatttttagcattaaagaatcttgttatgctccccaggacgggcatgcactttctcagcagagcacctctggttttaatgagccatctctcgtctttggggtcagaccctgaagggtcctcggaagcaagtaactgagatctggagcccaggatgatttacagacccacttggtggcttattgagcacctactctgggctcctcactttgttctgaccaagagttgatgctggattgtggcatcaccttacagcagtttatctgtcttccccaccagtctgtcgattccgagggaaggaactgcccttacacctttcagtatccctgattctccttaagacaggactgagcacacagtaagtgacacttctggacagattaccttgtgcctagcataaagcagacatgaacacagtagaaacttaataatggtgtagggagcgcgtgcattttcccatgtccgtaacactgagtaggatattaatggtacgtcagggaagacacgatgttcataggggaagaggcagaagggtcttcagcagatttgtgacatgagcctccacggtgaggggctacctcctggctccccagttttcactctcagctccaagctgggagtgacctggccaggttccttcagaagctcccaggagaacaagcaggtgctgtgagggcaactagttccacagagggaagagaccctgtcccggccctgccgtcacagggtccctggggccaacctgctggcttcctggtcctccagccattgtgaccgcagtcccaagacattctgttacccttcgtggccctagattgcccctctccctcccggaggccagctgacccgatgctgctgtagccgatttcgccacctcctggaagcaaatgcactgggcatgggtggaaaccagtttggctgtgttggaactgttaaaaacaggaaattttaagcaggactatttcctctgggactagttaacccaaatagggttgtcttgggattacttcagattttgaagtcagcgttaccactgagatcaaagaaattgaagagaaaatatcttctcggttggctagaaaccacagggttggcctctgtgtatctacagaaggtggtcacctatctggtgtgattgaagtggcgctgaaaacctctcctcactcatctccaaaataagtcaccacctgccagcacagggtaattaaggtcactcgtaggatctttgagttgaggccatagctctcagcatgtggtcctatgagtagcagggtcagcgtcacctgggaactttttagaaaaacagattctcagttctactgaaccaggaacccagcaggggcccgtccagggccagcttcatgggcgtgcagcacaggcagtcttagagggcgccacacttagaaagttctcaggcttggtttaatttttccaatgagaggtctcacatttttattttgcactgggccacgcaaattatgtagcagtgctggtctcagaaatgtttctttcagcctggcctatagatgattctgatgcatactcaaatttgaaagcactgagttaagtcattttctcccctaaagcccctgttcaaatgaagattttagctgggaaagctaacattcacagtggcatcgcccacacctgggacattgcatcatcgcttcagcgggctgatgagctggcagagaacaggtgtatcagcagaaaccccaagcagggatcaggtgtgcgtatgtgtatggtgtaaggtcattcccatgacctgtggttctcccctctccaggctagccgcctgaaccagggtgtgcagaggaaagaatttcccttgtttcaccattttagcagaacagagggaaagccaccggggcattactctgtacaacccaactcttggctctgaagccttgcccatccccggacaggacccactgtgatcctctgcaaaaggcatctgtgactctggcgtgttctctgatcctgtgtcctgaaagatagctggtcccctttgccttcactgaagcctcttggtaggaagatcttgtaatgtggatttgttcttcttgaggaataacagcaggtaacccaaagcttaaatttagaggctccaggaaaaagataaaagagaaacccagttcccttgcagaaaggcccttgaacgacatttcacagcattgatgtgtccctggccaagtggcccataaattgaattgcattctacattccttagaatagtctccatttggaagactccttttagttcagtgaatgttaatgtttgcaactgacatattactctcatccacttgttctgtaaatcaagtgaggcatattttgattgatgtttgcactggataaatacaaattttcataagtaaatgtctttggagttaaataatgaactaggagaagagggctgaaataaagtctgtggtttgtgtataacaaccaaaggcctggggcctaagaggtttcttttggtctgggacaagagccgagtctatatttttcagatagcagaggtatactagatagggcaggatactcaaagtgtgggtggttccgggtggaagttttcctaggctgcacccagcaaccacctgtacggcctgctgagaatgcagttgcctgctcactctgttttgcacctctgggcttcactctctccaaaccattctgtacgccattgccagactaatctccccaaagcagtgctttgagatgcactcctctgatcacatttgcttgacatgtgaggcccctccaggacactgggcctgcctcaccagcccaatctctgagactgggaaatggattctcttcttcagccagatgggcctctcttcagtcctaggactgaagcttgctccaggtgttttccagtgttcacacaatcccgtctggttcagaaggcccttcttgcattccacagagtgaaatctgttttttctaagactcttcaaatcttctttgcaacagttagttgtctgtgatcaccccaaagcgaccccctcgtcctctgaccccttagagctcttcccatctacacttttccttgggagcccagctatgacacccttgaacttttatttagctttgcatctctgagtgctacatattcctcacctgggatctgagcaatttgagggtagtgcatgtcttggagcagaaagaagaaagaatttactgttcttatagttttaggcactttacgtacttatccttacaattcagagatggaaattgttattcccatttagctgatgaggaaagtgatatccaaagaggttgttacttatccagagtcatagcctaataggaggctgatctaggaatagaacctgtgtttaactccaaagcctatgaatggttgagtgtggcttctggattcagctgtcaaagcttgctagctttgcaatctttatacctttggacaaatggcttaacctctctacacttcatctgtaaaatgagattaagaatagtagctacctcgtcggtcactgtgaagattacatagcatgcttagtgcagtacctttcatgtagtaattgcagtatatattagcagctaaaatttgttcctactactacgactaccattatattcaggcatactttgattgatgtttgcactggataaatacagattttcataagtaaatgtctttggagataaataatgaactaggagaagagggctagagggctgaaataaagtctatggtctgtgtataacagccaaaggcctggggcctaaaaggtttttgtggtctgggacaagagctgagtctataggctgtacaggtggttgctgggggcagcttgggaaaacttccaccctgaaccactcacacagcagctcctactgctctcattactagtgccagaagtactgttgtcacaacaagcacactgtcctcacagctcccgtcagggtgtcctctgtgcagtggtgcctgctgccaggcggaggcagacattcagatggttggcagtatgcgtttccagaaaagtccacccaatgcctttgcaccatccctggcaaatgcctatctgtgccagtcccatctgttttcactccacattcatgcaagctgtcccacccccccccctttccagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtgacaccctcctctatctctttcaaaagaagaaatgtttccatttgggggtagaaatgagtggaaggtgctagccacaatcccacttgacctctccctgcaaatgcccacggtgaccctcgctgacctcaggccacacgcctcaggccacgctcccacccccaagcattgggtttggctttgctcatgtccatcctggtagacagctctctactgactcattaacagaccaagtctctgtcatcatcagtagtccccgattacatctttctgtctgtggacctgacactggactgggattatgagaaaacccaattcagtctcctccctgcctccaaatctggaaggtggctcagcttactcttggagtcttttacttcactgttaggaataatgatgcctaaccttgtttttgaaacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaaaaaatttaagtatgtagcctgtgagatgagattggggcattgagaggatccagtactcagaaatatctcctgctggccctgcatggtgcctggtgtcccactactaggggacacctttgggttaggacactgtctctaggaggtttcatcacccaagagtcaagcatctctgccaaatgacaccacccaaaccaatgaggaactagtctgtgccaaagtgctcatagtaactactgtagttatctattgctgtctaacaaaccacctataacatagggctttgatgattatctcccagggttctgtgggttcagtgggtgggtcttgtactccatgtgatgtcagctgggctgcagtcatctgggggccagactaggctggggtgatcaggatagctcacacacgtctgggaccttgtggcaggtggctggaaccctggactcagttggcatgctgggacaacaggactgttctctcactctatggagactcagagactctccctctccatatggtgtctctagggtagccagacatcttacgtggcagtttagggctcccagaagcactaaagtggaagctgccaggccttctgaaggctttgtccccagattggcagagcatcacttctgccccatcttgttggttagagcatgttacaggccagccctggctcattgtgggaggaaactacacgaagccatgagtgtcaaaaggcatggcttgttggagctacttttggagaagagctaccacaggaaatggtaccctgatgagacgcaggtcaagtaggttttgatggagaagaggtttaaaaagatgtagcattcaggaccttacccatggggatacccagcaggtgccagtagatgagaggacccacacaggcagaaagcacgttgcaatggttgcaatggcagtggagcttcctgtcttgtaactgtggccattcaacaaaggcatgaatagggacattgttaagaggactgaagctttggtcagaattggggcttaatgactgtcaaggtcccttccaaacctgagattctgtcactggtctggggagattctgtgcatgtctagatgtcctctttaacaacctcacctgtcactgccatggggcttgtgcttgtccagcctgaataacagaggcagtgaggctaagcctacaaggtttggctcttattaccacacacgctgcaaaaacagacacttcattggctcacctccaccctattacagactgagtctgcagtccacatttgggcctgcaaagtacagaatcacaaccacctcctcttctaccactgccacagctccctcacccagctcctctgctctctcttctgcaggccttagaccacctgggtcctagggtacactggcagagagcaccctgtaggctgctcagtgtcttgtctggttctgtggggaaagggctaccagactttctaaagctctctaaaaagaggattcatgttctgcatgggtaggtgcttgaagcctgagaaagcctgagaaaaccaaagactgatttcttctgtactccagaaaccctttggcctttgggttcttagtgtcagttcagccactgaccatagtctgagtttgagtctgtgaccagaagcaagtaccctacttctctgttcctcagagtctttcttttcaaattgatggtattggactaggcaaaggcgacaacctttcagttctcaagtgccatgattcacagccaagtgacctctaattatctgagtagaactttagatctcttgatctgcatattgaggacttgggatcagtcaaactcaatgcaacagcaaatcttcactgaaggtgccagcctatgggtggactcgtgatctagacctaaagggttagtgtgagttcctagaggaaaagaaagccatgaggcagattgtggaaggctttgaaggccaggtggagggccttgaactttattccatagacaatggggagctattgaaggtttctgtgcaggggtggagtgatctgtgtggagcagtgtttagaaagaatgaacaaggccaggcacggtggctcacgcctgtaatcccaggactttcggaggccaaggtgggtggatcacgagatcaagagatcgagaccatcctggccaacatggtgaaaccccatctctaccaaaaatacaaaaattagctgggcgtggtggcgcgtgcctgtagtcccagctacttgggaggctgaggcaggagaatcacttgaacccaggaggcagaggttgcagtgagccaagatcacgccactgcactccagcctggcgacagagcaagattctgtctcaaaaaaaaaaaaaaaaaaaaaaaagatcaaatgtcagcatggggagaatccagaggttagcaagttaagaggcctcaataataccccagcaacagccacaaatgaatccctccagcccccttatacccaacaactggtctggtcctggtggtggggccagatcccaagatacaggtatatctcattgtatgctaaccccacctctgaaaattaaaatggcaagaatcataatttggtatgggagaaatggttttataatcgtgatgaaggaatgttctctcttttttaaaaaaattcactattcagtctgttactgagtggggtcccctaaggatgttgaagttttgttcaagggtgccacagttcctttgacacataactcttcaggaatatgtcagtcaagatcctctggaagtttaagtgcaggggctggtgactgttcctggaggaaggagtgtgactattcgaaacaaggctctagattgttctatgatgctgggtagggggcaggattatatctttgaaagtaggtaccagagatggtggtgtaggcaggatttagacacagacaagtgggattcagctggcactcttcattactttgttttacaaaaagtggaaaatggttctgaatcgggaggctgtttggcaactataaggaagtaagctatattgctggtcttggtgatttaatttttgctgagagagaggatatgatccaggttgagttaatccataaagtggacttgctcaccaagtccactgtaaggagattcgtaccagagttctctctagagccttgatacatatgtcacttcagggacaaagctaatggcatggtatcctgaacacagctattgcagtttgcaaatggggtacaggaggggttaaattcctcctgagagacaggttataaaggaaagacgggagtgtcggagagacatttctaacctgtgaggaaggcttacacccttggagtaactgtggcctcactcagactgtcccttggaatttctgcgagaagacctgggcctgccccaggaaagggtggctgagttagtggctgataggcagtcgttgtgtcgctgctctgaaggcaccactgaccatgttccagatgcaatgggaaatcaaatgatggagcagctcctcccttgtgggagtttatgctccagttgaggagataagcttgagagtgggaaccattagttcacaggccatgatggagctcagtgttgatggcagaccacaggtgctaagagagcagatatttggaaaatataaacaataggctgccaagaaaaactgcagctgggcccctctcatgaatatccatataaaactgacttcagctggttcttcccatccttccacatccaggctctggttttgggaaaaaaagcaaagacatgtccacagagcgggacttcttcatgaggatgaagtgcacggtcaccaacagaggccgtactgtcaacctcaagtcagccacctggaaggtagggcaacatcaggcctgggttggagtcccaggtgtagggtaacggcggtgcaggggatgcctaaggccctacccccacccccagcactctcggctccatgtctgacccttccacgcctgtctcaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacaggtagggggccatgggtgtgtatgctgtgggcagagatgggtcttacctgtgtgtgtggggagttgtgcctgtattaaaggtgtggaactgaacatagacgtggtattgccgggtgcatgttcgtggacctgtgccactgtttcattgcatcagtgcccctcagaggttcccggtactgtatttggtggtctcccattgacagagcctcagggtccatctgcagagctttcctggtgtgcaactcttctcatcattgtggtgtgaacatatttctccatacgtgtatcaggctcctgaggaaattctcaaggcagtcttctgccccaggagaaagagtctagagacttccatctgtactcctgcttcagaggccagtaaggagcatcagcttctgccctggagactgaccctcttccattactgactgagcctttccctccgccttgttccttcctgcatgcaactccattccggccagtgtccagccattttgaagaagatgaaggtagctgagccagatgctaaccccccagtgccaggcccagtgtctcttaggagacacagtagtgattaagagcatgggcttcaggactagatggcttaggttcaaatttagtaataaatgttcagtgttagctcttattatcacctttattagagttgttgaaagagtgcctaagactgcttaggcatgtcatgccatctcgggttcttagctcatttagaagattgaagcaggtggggaagagactggggttgtcataggagggagtatttagataccctacagctcctaactcccccaccagccctgcctctgggactgtggagcctgatgatgggaggtaggaggaggaagatggggagaacagatgcccggagcaatggccggccccagggagggaaggaaatgcagaagactgggcccagggtaggcctggcttgagtaagcgccactggggcttgctgagcagcaccccccgcatgcgcccttcctggcagagatctccctgcctgacctcagctttctgcagcatctagagccgccatgtgtcccagggtgacagttcctgtggcagctctttgccacccccaactctttgccactcttctctcatcttctagggtttctcctcaggaaaccctcagatctcagtttccccttctccaaaatagagataacactttctaacctgtttcatggggtcactgtaaaatgagataatggctgtgcaagcactttgagaagtccagacaccacaacacatgtgaggcttcttgttattgcttatatcttacttcctgtccttggcctcctccaaagcaaaatcttccactaaactcaaggagctgaaaccacttctgaaggcagttagtggctggggggcaggaagaggaagaatctgacccccagatcagcaagaatctgccttgtcttcctcagctagcaggaaaccatggaaccccaggaaaaaaagctcctgctcagcctcccctaggcctacccacttttctcttatcagctggacatcccaagggcatctggtttcttcatgggagggaccctcctctccaggatggggtttctctcctctgattccagaccggcctggtgttggttggtcgccccttcttagagttggccaccacttgtggcacaatttcagaacttttgtaaaagtatccttgagtcattcctgtccttcagttctgaccacagtagggccaggattcacagcctttggagctagtgggtagttatataagtagaaagaaatgctctaacctcatagggagaaaatgtcatgcatgaagccttccgtcctggaacttcgacacagtcaccatttattgtaattgttagtggtggtggtggtggtggtggtagtggtggtggtggtggtggtggtggtggtggtggtggtggtgataatgatggtggttcaagaagaagattgcacttttagtgacaggcactgcaggaatccatgttataggtaaggttatttatcagatgcagtctttgtattcaggtgaacattctgggcagaagacacagctttgtgtacctcagtagtcttgtgagataacatggacaatcccactgcatagcccctgtgtcactggctttgaggtgaagtggctcaagccgacgtagccatatagcctgggagcatatatagtgctggggatgatgaaagtcagatacgtgcttcaccctggtgaatgaagcacatccgtaacataactccataagcactgggaaaaccctactgtcctagaaaataacttggcatccctacataatagaaaagagattttttttaagcttaagattttgatccttgttacagtgagaagaaatcctctggaaggggtaattcagccttatcctttattcattatcttggtttaaatgagtttcaggtaattttctgaaggtactaacctttggacaaaagaagagggggagaaacacaaggaattggatgtctaaatgtggctggagaggaaatgtacatagaaaggggaaagatgctgtgctgacttcttagtttggctcagggctggtagccagagtagcttctggcttaaaggaagtatcaagcctcgtgatttagggctttgtgactcataatgtagagggtgatattgcttataagttctgcgagacacactgcattttcagcaaaatcttgcctttcaagaaacctaattacatggccccaagtctgaattcagtggtgctggagagctgcatgtagaagcatttaaagacatagaatgctgtgtcacacagaagttgtgtttaaccgattagcagattagttaacaagggcacagacatggcttagacagttgatgaagtgactattttaagtccttaatccctaagtgttatatcttaattgctttgatgaggcctgagatatttttggttttggtagcttgttttgttttcactctttgtggtgggatggggagaagcatatgcacatgcacacatatatacactctccgcctcaattcccctttagagacaaatcctgcaaaaaccaatgcctgtccaagatacctaatggggtgaggggttctccattttaatcaggaaattcactaggtttaatgacatctgagacacacaaggtgctgtgattcccacaaaggggattgttttcctacaagaaaagttagaatctgaagaaaatgtatggcagttagaatccacaaaatcaattttgaagcagtttggtacttgtcttatatatactgagaccacagacacaatcaagcaaaaaaagaaaaagggtcatggagaaaaagatgaaaaccgacaggaaagaagggagagaaaagacaactctaattttacattgaactctcaggtcaaatcagttgaatctgaaacaacctattctgaaacatctgaaatagaataaaggaatacagatggttcaaaatgcatttgtcctcctgttaatgagggatcagagtaccatattaagtcctgcattaattgtttttaaaatagtaaatacttttaaaagtaaatttcataacaattcatgtcggtcacatttatgtacctatggtcaactgctctagacaaggggagcaagttgagtagcagggtaaaagaaaaatatcctgattattaatggaattaatgatctcttcttcatttacgactcaaacataggcaatatactctgtttcccgaaatactgagcaaccagttacgaactgtcatttactgtgcatctgctatgtaactgtgtgccagagaccattacatcaaagtaaaagagatgattcctgatcttcaggagttgagagtttgagacataagccatttaatgaaaccacagtgaatggtacaaaatacaacattccatttacccaaaaggaagacaaaagttgttcccaagtagtttaactttaaaatagggtggttcttaaattcatgtggaggtgccatctagtggtgaaagaggtaactgtgaaggaagccaagccgtcagggagatagaggccaggcctttctaattatcatataatcccactgcgattttgtcagttgtaggagtcttcctgtatcttagaaataaattataaaaccaaattatgtggataggagcagtatcaccaggggaagaggtttcaaaattacagtaaaaatttcaaatcaacaaagagggtcatacaatttttacaggtaaagaactttagggcaaccctgttttgtcattgcatttagggaacataggacatattaatatcaggagttacagttgaataaagatgcctacattccaagttctgtggataaatttatggtgaattgtttttctacaaagaagttgagaataagtaaaaatggtgaaagtgagggaaacgttgaggatcctaaagataatgtcagtaaggagaactataaagagccataagtggtaaaacacacacacaaccttcctatgtatactcttacccctacaggtaccctgtaacactccacagacaggatagaaatggatttcccgttaattacagagctggttgtatagatttcatataaccatgtagtatttgaggaaaacacaaggcttaagtactgtttaaagcaaacaaaatctagatgaaaatatattaaaaccaaccgaaggcactgaaatctgagttagtgaacagcgtacatattagtaaggaaacgcagtgtcaaagcttataagcacatatagaaaccaaaatgagataaatcacggggtgctgaggagaggcgatgggcagagtgtggaaggaaagcaagccgacttgaagtatttattagcagatacattctttggaaaacaaataggtggttacaaagtacttaaaactttcatcctcttaaacagtttaaatactctctcaccatcttgcttacatgattaatttacctagcaaatcctttactcgtgtagggaacaggggtaaaaactgcagccagatcttgcgtgactccaggcggtggcatctgaagtcaggcaccgtggcgctgcaccgcacgtggacgggtgctggcgattacatgcggggaagaagagcgagccttctcaggcctgtgggtggatttctttctgccacttgaggtggcagcactcacgctgtagccaagagaataatttttttgcgagcactctgctgtaggtggtgtattttgaatagagcttctaaacagttttgagagtaaagagcaatgaatcattcattttacattttgaaggcacatctcactctgaagtccagtgctcagagagctgacccacgtatttacttggggtaacaccaacttcagaatttaacaaccccctttaaagctgtattttctatttcctttcatccttcctctgcctccttgtggctgactatctatctgcatctctctcctcactgcatccttggtctgctgttttttgactttattattaaaaagtatcctctgttcttatgtttgaaatctggtgaattaagtccttgtacatttctctcttctcttagaacagccctactgagttgactttgaaatttacgggtgacctcaaactgattttctttttcccagtgagtcaggggtccttaattagaaagaaagaaaaaaaaatagttccctggcccctgatggagagagcagatgaacttgtgttatcacagcccagctcggaaggcttgtctggagcctgggggaaatgagcggggaaggcccttgtgtgccgtaggagcgaccttataaacaagctcggttcattaacctccccactggcgtctacgtgcctgcacgtgggggcgaatgaccatgagctttaagttggggtttcctggctttgtgaagtttgacaactcaaatgttcttcaattgtgtttgggatgtggtgtatttcccagtttttatagtagtctgtttaaaggaatgaagaaagacattaaatatttattttagttgacaagataaatgaaagctgctactgggaagatatctggcagttctgaaatctaggtttgtttttccacttccaaaacatgcccattgtatgcctttgaatggatgatacattaattagataaacattttattatgaggcagattataataaacatctactttgaacattttaatttaaagattctaatctcgaaaggaaatttaattccttcagagagtagaaagacatctttcctagaatgccagtaggctcattttggagggtctctagaaaattctagacctgcccaggaacagaagcagtttatctggcaagtcagtgagcctgcagatggccagaccattgttagcagggcttactcatgcagttctagttcccaggctaagcttgaaagtcatccgacccagcagcgaagccatttgatcgtaggaccagcactgttctgtctccttgttccccccagtctccacctttgccaaggtgtacttgggcgccagccccagggtcaggttgccagataatgtatccattgctaatgagttcagagacctctctgctcagggccaagcgacgggacagatccttctgctctgagactggctggctggcacaaatgagctgctaggatctcactggagaaatctccactgggctgaatcagctgagacctaagcctctcagccctgttgagctgctccttgtttgacaaaggctttaacccccaaattctcacccaagcagagaacttgcctcttctctgcccacttcaaaaccagatgacttacagaatgaagaaaggatggatagactatcatgacaggttctgtgtgtgtgtgtgtgcgcgtgcatgtgtgcgcacacacattgagacagttaatcatattattctagaaaaaaaaagtagatccttagtgcccaggttccttagcagtgctgggataaacaggtgtctgtttgtaccgtaggttcaaagagaaaatcaatctactggtcagctgttgaggtttttactaagcacccgttatagaggaagcaaaaggagaaagtggtccctgagttcaggggttgacagcctaggatgtgaggagacaaatgcataattttctgtaatattgtgcatactccttaggacttcacgagagacgttgtgctggaggaactggagagggctctgtggagaagatgaggctttagctggtcctggaggtgtcagggcttggagaagaggggagaagagaaggcataaagcttctgcagcaagaatgagttttccaggcatagggaactgaggggagaggggtcttccatgacagagggtacataacattttacagatgagttgaaaatcaaattgctcaaaagatggagagtaggttctggggggacttggaagttacgcagcatttactgttggtgtggttggcaaaagtgaaagctgtagatacttaaataagagtatggcaggttgcaagtagtattttagggcaatttggtctgacagatgtatgcaagttgacctgtttggggggtgggtttagagcagagacaggaaatgaggagccactgcttctgctttctgcttctgctttcctctccgtgttattgatcccctacaaggataaattataggactgtatccaggagtcatgccttctgaagtagagttgtaataatgagactgtggcatcacttctaacttgtgataggccaagtaaacaagacagtgaagccattatttaaagtctgtgagagaaccaagattttgagagataatatggaggtattatatagcctaggataggacatgatattgggtaaagcggccaacctggtggttcttaggcagggctttgtttattttagtgattacagcacaaaacaaagggtcctaagaatgttaagtgattcttcatggttctccacatttgccctttcctctgcccacttcccatcaaaaccagataccttacagaatgaagaaagggacactgaaatgacagccagtggtgtcatctgagctgcctattagagtataataaggcacatttctatgactatgatttaatatttcttcctctcagcacctccttgcctccctcgtttccttgaaatgtgaggcacaagtagaaagtgtccgagggcacctgaggtcacaggcaggacctgcagaaaagtgaaggtttaagcacagacgggttctgcctgcctggactccctctcacgtgctggttgacacagagacaaaggtggctctacctggggccacataattttcatgtttcatttatactgccttctactagaatgagcttgatgtagcaactggaggccccagttttcattcttgctctgtccctggacacctgtgtaggcatcgagcaaattgtctgcccgtcctggatgtctactccctcatctgcaaaaacttggggtgagccccttccagtggttcttggagaacagacatatgtgtgtaccggggtggtggggagagggagtcctcagaactggtgcttttctctcctcccaaacatggcttcaggaagggcaggaacaacaggggtttggttaaacctgcaactgtagattgagcacagtgttcttttgcttggatacatggtacaacaagaaagtctggattgtgttcatctgcatgtgtgtgtttgatttgccttctggggttagctcctgcccacatgctgtgctaagttaatatggtctttcttccttacatgctgcctttttaaaaactcagaatcacagaactgattggttaccaccctgaggagctgcttggccgctcagcctatgaattctaccatgcgctagactccgagaacatgaccaagagtcaccagaactgtgagttccaggagtgccccttgtggcttccttgtgtctgtggtatgtggccttgagtggggtgtgactggtgagacagaagaccaggtcacttcctccacagagctgctgtcttgtgtggcagacaagacttatgccctcaagatggttagaaaaccaaggctgccaccagcctatagactccttcgtgcaaattagaaaaaggacacttcctccagggagatgcacccgtgccaaggtgcacagctgaggcagtggagggtgggttgagtctcagtcccccataccacctccacggagtgcctgtgtgcagtcagtggtttgcacaccttgtggaacagcactgtagagagtaaaataattcaacatatcatcaacttgggtgcatgctatagattcaagtacatacattcacagaagaggagggcagggggagttgaggaaaggacacttgagttggaccttgaaggatcggggaggcttaggctgaacagaggggaaagtattacgggtccaacttaacacatatgttgaggtaggccacagttctcagagagcttgcttgctggatcaagggagctttagaaaaggctgtccaggcaacccagggatggcgtatggaaactctgctttgcagtttgaaagaagcctgagttatgtaaggactctggaagagggctgccacatagaactttctgcagtggaaatgttcttgaaatgtggctagagaaaccgaggaactgaactttatacaatgtagttttaattaatttaaatgtaaatatccacacttggcttgtagctaccatattggacagagaagttctagagtgtatccttggccatgttcccaattcaggcttcctataggcaggtgatccaggaccgttcccttgaatccatgcgactcatcactgtgcaagggctctgggcctataaccctgtacttggcccactgggggtgatataaattggtagaattgattcctgccctaagtgaccttatttctgaggaaaaaagaggaccgtgggctccttgggaacaaggggctcatatctttaacctcagtatctagcatagcgtctggtacagaacaggcactaaatgcactatataaaccgatgggcaagactgtatttggaaaagaatgcttcaaaacgagtgcccacagtggtgcagacagtggtgctgagaggattatgggaggattaaaaacgggtaaagtaagtctgagaagattcccagtggccctgctggcaatggagaaaacggaagggcagccatttgtccatggctcctaaatccacccatctaccccaaggctaagacagccaagttcagtgcagccagcagagtcacaaccccgcaagctgtatgtgaacatggttaacccactcttaaggagtgagatctttcttttcttttattggttcctctgcctcttcctcatggcttttgggtttgatttgacagtacaacagggcccattatgatatctcagagaagtttctcactgtgctctctggcaaaacacacacgcgcacacacagacacacacacacaaacaacctagattcagccccactcaggaacccagagatggggtaggagtggaggtactcttttatgcctgtgaatgtgaccccaccttagcctgcccaagctttgaaattgtaacatctggttccagccttccctttgggattccttcatgcttcctggtccctgaggggttcctgttttcaaaggcaggtgacagaatcatccaggcactgggacttagcggcccaggctctggcccagccgacccactgattccctagggcctggatttctggaccttcctgactttagatgtaaaactggggaaaagtctagccttccttccaagctaagggtgaagccaaggcaagagacaaatgtaaaaatttctgggaattcttggaggacagtattaccttttatcttgtaggatgggaaagcagaagaagctactgtcaaaggaaaaaaaaattgtgacttctgactaggcatatagaaaggattttccctcttgttcttcttagaacatcttcaatccataaaaagggctaggataaaaatggtttatgttttctgctgactctagggaaaataaggtgctttttactgaatccgtgtatttacttattaggcacactgaaaggtaactcacagcccaaatagaaatcacaggctctctctccccttgatggagccaagtaaagctgccctgagctcagaaacccatagctagcaaagggacaaacccatagctagccaagggaaatctgcttgggttggaaattggattaatgacagttatgacacgagcttgccccttgcccccgacccctgtctctcattcgtccttgaggttttgcaagtcaagtttcactacagactgacacacatgctctagactaactggaggctcaggtttgagacaggtccagattcacacactgggatcccccatttacacacatgtatgtcttagcctgtaaaggtttaccgttgaaatgcctggagaagctcaactagatttagatcattgaaagctgtaatttccaaatggattaataatttatacactgttactctgggcgtgaggttaggggtcagtctccctttgttatatgaggatattatgtgcttttaggctttttatggcctttaatcttattttcctatctattaagtagcaggcccttcaccaaggctggcattaatgaccagatgattagaaagctggcgttaattatattctactgacagagcaggcccttgcctgcaattgttagaaatgcacttaaaacctttgcttgctgcactgtttgatcaaaaagagtaagagccctgaatttggtttgcattaaggaccatctaaataagttaaatacaggcacttgaaattgtgcaagaatcattttactgcagcagaggagcctcagtggcacagataaagggagagcagagaggacaaaagttatttccttggttgagtccatgatggtttaggacagcggcaacagcaagtttggtcttcccagtgatttgtggacccaggtaataaagagaccattgtattaggagccaccagacatgttgtgtagctcagactctgtcactattgtcttgtaagctgtgaagcaaatcataaccctctggccttagtttcctcatgttaaaagaaaatacttatcctccctgtggcacagggttttgtttaaaagattagacaagatgatacaaccattttggaaataatttggcagcttcttataaacatatactttacaggtaagccagcaattgcactcctagctgcacccacgagaaatgaaaatatgtccatacaaagatttatacacaaatgtttatagcagctttattcataataatcaaaaactgaaaacaactcaaacatccatcaacaggcagatggataaacaaattatggtatgtccatgcaacggaatacaactcactgatgaaaaggaataaaccacaaatgcctgcaacgccatgatgaatctcaaaacatgctgagtgtagagaagccagacacaagagtagatactcctatacaattccacttacatggaaatctagaaaagacaattcgaatatatagtggcaaaaagcagaagagtggttgcctggaaccagggtgggaatgaagattaactgcccagaggcataaaaaatggggtggtgggggcggtgatggaaaagtgctatgccttcactgtacctttgtcaaaacttgttgaactgtatacttcaaatgggtgtgtgttttattgaaggtaaatttgaccccaataacatttatttttaaaaattaagagcaaacagaaaaagcttagactaggaatctttaatttgaactataattctgtctactgtttccactgaggtggtctttcagcaaatgactcagtagttttaagcctcagtttcttcagctgtaaagtgggaataacaacaggcaccccatggtgttgcctatgaaatgcagtgatgatgacctaatccttagtgagcgccctatgtgccaggcactgtgctgaatgctttgcagaaacgaattcatcttatcagatagttctgaacactgcaaagcactatacaaatgtaagttacaggaattcttgcactttgcaggtgcttgttaaattgtgaagaagaaagcaaaacataagtgtaaaggattaccaaactgcactagtatgaagagagccatgttcctcagctgtacagggctgatgaatggggaggaggcctgcgagcctaccaggagaaccggggagactctctgtctaccgagagcctggatatcctcccgagtggcccctcatgagactatctaccaacgtgtaacagactgtctgtgacaggccatgggcataatatgtattagtatctctaagaaagaggtggcttttcctatacaaaatttgttggtgacagttggtcaacacttatgtacctgataagccatgtgggtacagtcgatcctcagtacaaatggcagtggtatgctgggtagctaatgatgacagttattaccgttactactattattatcaatatcctgttttgcagaggaggaaaccaaaaccaagaaggattgttcctttccccaaatcccaagctagcaagatttcccgatcctccctccatgccctttcctaacgtctctgtgatttgggagcttctgagctggagttctgtaaattcccaaggaatgggcagttcagaaaaataccaaaaattctaacattattagactttaaagagatttattgattccttttgaatggcagcagatggaacattctggactggggaaggacagtctgtgatgtgaaacccttccccaaggtagacaacaaaagcgttttttaaatgaacacttagtagaacaatctagaagaggaaaaacctcataagtaggaagcctagctgggcggttgggagaaggagtataagtgatttattacagcttatgaagagactgtgtgtgggctgccagggtcccagctctttctcagccccaactgagaaagggtggggtggtttgcctctgcctttgctgtgggtcacaaaccttcagtggcccaaaaggtggcaagcctgacagatgacctggagaaatcaaggatatcaatgttttaaatgcttttattcataagcagggtattggtggtgggtctgctgaaaaaaaaaaacaaaaaaaaacaaaaaaaactgccctgaggtcaggctttctccaggctgcttagaagtccccccacctggagtgcttgacgggatggcgctccttacccagtgtgaaggggcttcttctcattgaaccccatgaagaaagtaaggcaggttctggacttggttctgcttatagctgagctggtctgtgagcctgacttgtccagggattggtgatgggccactgcaaagctgcatagtgagcgggtccctccctcagtagacagccttgggcaagtcatttcacctcttctcacctctttttcctatatttaaaatgaagagttggctgaggtgatccctaagctccctcccaggtcactctccctggtcctcactgtcgtggcgccctgttctgtctgttcccctgcagattagactgccctcccatgcgatctgctgagcctgtggtgcacacccctgccccacctccctaagctcagctctgtttctcctcccctagtgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgaggtaagcatgtgagggctggcgggccttggtgcagggtatgtgggggtgcccaagcttcccagactcaggatgacaggcctaggagatgccaggcctctcagcgccctgggcaccacctcagggaggtcttgcagggctaaccctagtgactgagaggacttcctgtggatgtcttggaacagtgggatactgggttgggatttttttttctgcgctttccctggcatctgtcatttatgccatgcatctgacccaggtggggaggcagatagcacacaatagtcaatattttctgaatggggaaaaaggaaagagaatcgcttatgcttttgggaaaaaaaaaagatgtcatgccttcactctatagtacctggaaagaaagctagaggaagtcatttctagttgtttctacagacagagaaaaacaaaagcatcaggcctcatatataccaccccactcaagtgcaataatatttaataaaacaggatccgaaacagacatacattcagaggatacctctgttgtcactacctccatggctcacacacttctattgtatggttctttataagacgccaatgcctggagtcctacccattttttgtcggagagcttagctatgagggtttccatgcatctaggggagcagaatttttctagaaaatgtggaaagtctgaatggctctttcccccccattagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcggtgggtgcttcttagctaagccaggcccctggaaccccgttggggctgggaagagttcttactataacaggcctccctggctgcagctttttcttaaccagagctaccccagccccccaagtcttgttaatcacctgttagaggccaggccctgctgagcacaaaagaacaccacacgctcctgccctgataagaccatcccatatccgacctcaccaagtgctgtacgaggaggggttaagagaggacacccccctgagggtcgattctccaccatgggtggtgagagtctgagatgagagggaggggagaggtgagggatctgctccgaggccacttggacactgtcaaagagaaggggcagattcctaccagggtctggaaggacagatggcttgttcaggcagagggccaagttggagtaatgttgggaaggatcattccaaaaacacagagaacatattgaggcctgggattaagccctcaaacccacgacttcattaaagtgtctgcctgtccctggggatgtaagtcactggggaccccggcagggttttcagccctcggctgctccaatcctggaaacacccttgaagccccatgctccccagttcgcaacccgctgccaccctctcctggccttgctgtggctgccggaagagtggtgctcaccctggactgtgtcagccccttttagatgggttctacagcggccacgtgaggattgcagctaaagagaatctgaaacgcagcgggcccttggccagtaggtctcgcggcttgttttgtggcagtactgaggcaaatagctcaatagcccaattctcctctccctctcataccttccttgtctacccttccggatctgttcctcagggaagagtggctcctaatatatttagtctctgaaaattaaatgtcccaggagactgttccgtttaaagggagtctctacgttgactcatagccagagtcaaagacccatgtgttccagctgagccccagggtgttgggggggcctagccccaggcatgccttccagaccctcttagggccttctctgcggtttttgggcctcctctgccttggggtgagcccgatggttgtgggtgttcacctcccaggcccttgtctccacagggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacggtgagcagccctcttatggcgaggacacagagagggctccgtatgtatgactgctgccagatggctgaagggacatttgggacaggtactgtccttctcaggttatcacagagccccctagagtggccgtgacacttacctaccaggtatcagagctgttttcttccttttagtgttcatcccccaactccattgaaataagctccttgaagggctttgagcccccagctcagtccccatacagggcagtaacatcccgtatgtggcacagagctgcacagtttgcacagccctgctggccacagcctgtatcctgtttggtcctcaagacaggacaacctgtgaagcgacagtagcctcattttatgatgaggagactggaatttagagaggttgatgaattgacctaattcatacagcttgttaattagcagcccctctacaaatagttgtgtggtggaatggaattgaacctttgggtccaggaaggtatttcttcttccatgctggacttctggggagaccagtgccatatctttgactctgtccccctccttcctggcccctagcccaatagccctgaagactattacacatctttggataacgacctgaagattgaagtgattgagaagctcttcgccatggacacagaggccaaggaccaatgcagtacccaggtagatggctgtggagatcaggctagggtgtgtgcctgctgtctggtggacagcaaaggctcacatccattcttgtagcctcatccctttgttgtaaagagcagtggagacgtttggccaaggcccaggtcccctaaagaggtaggggtacagggtaatggagcctgtggtcaccccctcctcccactgtcaaatccagctcttccagcatatgtgtctcctacttagatagctttcttagcacacatgaaaaccgaaatgataccactgcacctttctttaaacaggccctacatttaacaagcatagccagatgtataaaacatgtataaacataggggacaattaatccctttataaacacattcatcttgtgattttaaaaaaataatcatttttatatgaaatgcactttaaaataaataacatctgtttgacaatttttcatttacataaaacttttcaggaacacatttattacataaggccaatgttcttgcaaaaactatgtaaacaaggataaggtagagggaggggtacgtgttttacaaaaccccagggaaaaccattaatcccccatttgtcttagtcttgagttcaaccagatttctgccttgccacttagtttgtttcttgatcctacttggcacaaatcccagctactctgcaaaacatgcccaattttagcttttctatcaccctccctcctcagcactcctgtagtatatatcatgtggcacttaatcacagctatctgcttctgctccttaaagattgcttagtattgcagtcattagtcagctgacacccactgagggtgtcagtctctgaagttagaaactgttttccgcatctgcttgtattcccctgcttgtatcatgcgtccgtcatgatactgccaccctaagggatgatctgagtatctgctgattggaaccaaagtctctgtccctggggtctggctgttaggctgttactctgcgagagtccacagatggacctgggcacttactgcttgcttaggcccgtgccagcttacaggagggagaagaggacaaaaaaaagccacagtgtgcaccacaggcctaagcattgtaggacaaggataaccaccacaggctggagtaggcagggctgactctgtggaagaggggctgcctcggcttcaagagagaaggcgggctccggacaggtgggatggggagaggagaacatttctcaatgtgcagggtgaagaggggataaacatgggggaaggctggtacatgatacaaggtcgtgtacatgacacagccaagtctgaggttttcctgataggccctcgggagccagtggaggcgtttgagcagcactgtgaaacagtgcttgagatgaatggctctgcaggagctgagttggaatagtgtttgtgaggtcgtaccaacccccttgcctctttgccggtgctgtctcccctcagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtaagtggcagatactcagctgtaccagcagggccgaaccgagaggcacccactagtaagatagctggacccccagggaggcccctgcccctctccccagccatctgataccccatttagcccttctctgagctcagactttggggaatcacctcaagccatgtgaggcctagtgtaggatgggtttttatctgggctgccactgagggcaggcaaagaagtggcttgttgagagccctgtacctcagtgtctcccttcggaccaccaccagagtgcctttcgtatctcggttcatcatctgagccacacagaaaattgagtgatgattttccctggttgaaaacagcaaaaagatacccctgcctccccttgccttttggctgcccccgggtcctcgccactgcagcctctcccagctgtgcctaggctccagaaatgccttcccatctccccagcatgctcatttcaccagctgcgagctcactgggctaaggcacaggggttggtacatgacctgccactcccaggggccgctggtacttgccctttatagagcagccaaactagttttcagtgggagcaaaaggcagaggagagacatgggcagaagaaaccctcctaaggactaacattgcccagccaggcagccatcccccagaccaggaggcttgagcccttcagcatcttatagctgaggaaggagacagagctcgagctcggcctgcaggtgcacagcctgcctctgagactctgccttttgggtctttgagtcatcacaggcatcagcattgggactggaagggcccctaagatgagaaggcactgagtggcatgtggctccagactccctcatagcctgctctctcgggcttggcaggtctgcaaagggttttggggctcgaggcccagacgtgctgagtccggccatggtagccctctccaacaagctgaagctgaagcgacagctggagtatgaagagcaagccttccaggacctgagcggggtgagtcatccccactggccacaggggcctctccatagcccttagggaacccagggctgctgagaggggtggggatgtggcccttccaagccagcatagcccttagggaacccagggctgctgagaggggtggggatgtggcccttccaagccagcaagtgccagccctgttccaggcccacccaacccacccagtctggggacctggttctctggccatttcccctttccatctgcccttcttactcccagggggacccacctggtggcagcacctcacatttgatgtggaaacggatgaagaacctcaggggtgggagctgccctttgatgccggacaagccactgagcgcaaatgtacccaatggtgagcagcggccacaggcctgggcctcctgggggttctggtggaaggactggggctcgggagcccatcctggttcttccattcaccacaggccgtacctgcctctctgagccttgttagaatggggcgatgtcctctgtctctcccgcagtcccacacacccaacttttccatctccactctgacttagatgatgccatcagagggtcctgaaggttggctgtagttctggtgactctgagcaccttttataaaggaaagggatgctagggcttcctggcctctcccctccctcaggccaatgctaccgtcactctctgactttggtctttcagataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggtgggtgtgcccaggatctgtcacccccatcccaggattcgatgccaggggaagcccacgtctactttttttccagcgtctgcacagtgccaggcacagggaggtgcttgacttgaagtcacctatacagggctcaggtctccttggatttagggaacctcctcacaagttccttgtgacatcagtgatcaggccccccagtgggtgggtctgagacacagctaaaaaactcaaactcaggctagaatactgaaggaaagaatgcagaccactaccgactgcccaaagaggactgaacactgaacactgggttggcgacccccagaacactgtaccactgttgacaggagcactttcagaagaaagagcaggcggccacagtggtgagggcctgttgaagaagagaagagaaagttcagagagagagagttgggaagcggtctgggcagaggcaggggatctcccgtctatgcaaggatgagcttgctgcgtggagaagggagtgctccttccctggggctttagggagaaccctcccatgatcaggtgccatccagggctctttccaccctgagaatcccggagccttgccccttcctcagttcttcatgtggatgtgttttggggtgtcactctgagttcaggcaggtgctgagaacatgccaaaacttccttcaggtagaacagcctggaaagctctggtaggcccaccccactggacttggttcaactgcaggcaccaatgcctgccttcaaccctgggccaccttcatcttgacagtatcttgtgaaacatatatgtcttcatgaggtttgtttggcctgaaaataattcgtggtttatggaaaaacataccaggcccctgttctaaaaggcaatttcctcagcaatagagtttggggaaggttatagttctgtgcttcagagtccaggctgtagaaacaccagacagccctggcttaaattctggctctgctgttgagttcaggggctggtatatatttatgtgcagtaagaggtagccagcactattcttcctgttatgtgaagcccacgaattaccttgaatattgaaatcaagggaaaatcatattcttttcaaaagagttgaatcatatcaaactcttttctgaccatgaataagagaagttagcaagggatggtgagcaggtatccattgatactgtccacaggagcagtcaagctggggaggcaggcatggaccccagcaaggatctgagctaggaggtgcaggaggcaatggccactggaacgaggctctgcagataagggaaggtgggtgggcatctcccatcggaggggcagaatgcagggcttccaggctctctgctgccacctaagcctttcctccttgggatgggggcctgtgtgtgtgctgcgagtgtcccccctgccactccctggtctgcctcctcggcaagagaatagcacagaggcaagaagaaaggactgctgagggtggtgaccagaaactggattttcagactgttgaatcttgaggcagtctgtgtttgcatctgtatgtatgtgtgtgttctgcatgttctgtgtatgtgagcataggtgccaggtggttcagcctttcctccctgctgccaggaggcatgggggtcagcaaccccaggctcttcctgaagcttccacatacctgtgctgcagcccgcacctcacgctttcctctttcttgggtctcagcaccccacctgaggcagtggttctggaggcagacacgttccccgggcatgcagcaggccgtgggacagacaccactgaaggagcagagtgaaattagggctgctctattggtatcccccagtcacaaagaagtagacacttttccaaatgttcgatttaggcctttaagttatggtaccaacccttctttcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcctaccactg

SEQ ID NO: 1363 - DNA, 81788 bp, Homo sapiens
accagaaaaaactgaatgtgtgatttattatgtttaagattggtttataaggcttaaatatatctgtcatagttaacagttaacagcaaataaaggcaactttacaaaatcagtgtttccatacagtacaggactaaatgtggcaactgtgcattggaaaattaatatttcctcaatgcaaatatcaaatctgcagcaccatttagaagcttccactaaaaactcaagctgcagtatttattacaagctctactcagaacacaaggctacctaaatcaagcattagagaaaaacagtggagtcattcaggcataatatgtcagatttggtacaggattaaaatactaacatttttaatgtcctggtttcaaattaataaatacaaaaacaatataaaaatatacaaccagttgataagactgtactgcagatgctcagaaagttaaatctcgctctcatatgtatgcaggtatgtcttgagtgtcaggatttctgggtagctgcggctggtctttcggaagaagtccaggctggtgagatgttcaatgtcacgcaccctagctgtgtgcatcttcatgagttcttctacccattttgattcgtcctctgagctctgcaatggaaacagaacaaaatcagaatcagaattttccagaggagtttctccaaatggtcagtttactccaagtccacaaatgacctctgtgcactcttgcacacagagccaacgcatgttgatccttcctggcctccctgccactctaccgcattcctatgggtaatgtgccacaaatacctgcccttggctgtaaacattttcaacagcaattaactgtaccaaataaacgagacatgtggtgtcagagggcatttgactcaataggttctcagaacataaatcaaaattaggaaaaccaaaggccctagagaattcagtaatttgtttcttttccaagctgtcaaattgcaatattgagcacagagtacaagtaacttggaatatgcttctgcttcccaaggaaagtgaagaacttaagcctaatgcacgaaatgatgtgtgtgcattcctagtttttcaaaagaaactgctgcatcaaccacgtcatctactagaatgcataaattgctatttgaaaaatgaggtcaactcgaaaccactcagttgacacatctggcactctagggcccaacaggccagagttggaaatgaggctgtactacttcttggctatgagaccttggtcaagctacttgacttttgaggcctcagtttcttccttggttcacaaggataataatgcttacttctgcagctccctgggaggttagggaggagaggagggaagaagcggggggaaaggtaaagcaaggaaacacggaaaaaagaaagtgaatctctgcctcagctgcttgccaaaaattgccccactgacacaagttgcagatgaaagacattcagatgtcctgcatcaaacaacttatttcatgtctaacttgaaactaaaaggtaattcaggggaagcagttctttgcatctcaaaaatagcttctttcatttttgtgggaagttgagggaaagagtgagatctgagagccctgtgaatatggagcagtgtctactttcattagtagacattgagcaggacctttgcaagtaattccattcacaaatgcctctggaattgcaatggcttccaagagcccttctacaagttgaagggtggctgcatgtcctaggtctgggaatattcagacatgccctcatccaactctttaccaccagtggtctcagtgaactatccaccaaagcccaagaacctgcaatgggctttctcggaaagctccaacccacacaaacctggacagggaactgcagcagcttgtgccagtgctaaatatgttcgggagggtgttggttcaggaaactgatgcctggccatctcaggcaaaatgaagaaaggggaagaaattgctttgcaggctggggaggtaagaattttaaccttcatgtcccaccctcctaacccaacctaaccaagatctctgcgattcacaggaaaggaaagacctaaatataactctacccacaatggtactgaccagtcctcagtgtgaccctataattaacgaagtaggaggtctccagatgggtcaggaccccctcagagtaagcagggcaagcatgagcctgtattttgagagaattttcatattcagctcatttgtttgatttttcagtggtcagtcagtccaatttttttctttgtaaatgcagtcattttgaatgtgtggacaggggtgaaaaggtttttcctaatttaaatgatggctagctgggattataagaattctgcaaaaacatctgtcttttgctatttctttccttgggaagtgatttgccaatttcattggagaggcagtctcttccggttctcacactctgaaatctgttctataattcatcattaggaaatactagctatgtggcatgtgaaggaaatatcttctgccttgatgttcgctggcaatccacagaagcattcgctgatgaagactgtgctgcaagatgcaaaactaagacaattcagataaaagttcatgaacagcaaggtagggaggacaggaaagactttaaaaataaagcacttagaatattaatgcaaacaaaagcacaatccatgaacttgcttgctgtcttcctcattatggacattgattcttcacctgtcttttctccctgactttctccccaggtttgtgaattcaagtcccagaagttttaaggtaaaattcacagcaaggacagcttctacatgaacaggtgacccttcaacgagaagcatgctggccacgaactctacaagaagtgcctccagactctgtgcagagtcaggaaccagtagggagaggaaaacctgtaaggacttcagtggatttcatttatcagatataaaatttagatcgattacagaacagcctttgtaccaagtttagagcagtatttttaaaactccccatcaccaaattcctctaatgaccgaacttgaacatctattccccaggaatctaggtacaccttaaatggcctactatgtatatgaaatacctttgtagtcttttcatcttagaactgtatggcaatttttatttttatcccataatacaacagtttaatgttttgcaagaatttcacctccctacaagtttctaataagactgaagctcagagaacgtataccatgttatacggaggcattacatccacctggggcttttgtggttgtaaacaaccaaaattgagagggccaagccagtaagttgataacagcttgtctctcacttgcagtttccacatttctctaccacccattcccatcatttataaaaccctatggatccttcaagtataatattgttgtcttccatccttccttttagatctccaagaccacaaccccagttcaagttctctcttgcctcactcctgtgaatcttgcctaagccctttgagcacaatgttcagtctcctccatttcaaatttatcttcctaaagcagagccaaaaacgttgctcttccaactaaacattttccttgggtacctaatgcctaaaacgtacgaaaaaattcctaaattcccaaggttctactatggaagtctgataaattggaaagaggatgggctcttggagtcagaggccttaaatctaaagctctgctcttctgctgactaaccaagtaaccacacaacatactttccccttagtagctataaatttctcaacagttaacaaaaaggcaggggagagatcatatatatatatatttgcctcatactgtggttatatgattagaaataatatatgtagaggacctacacataatcggatcacaacatgtactcaataaatggtaacaactactactactgctcctgctatgatatctactatagctactattactactactactttttaaaaatttgattccaatcaacttttaaaatcttttctcccactatttgccctcatttctaatattctggcaaaacttaattcactttctgggatatatttaaactttctaattttcttctacattcatagcctcaatcttcacccataattgaagtcaacagatcaaaaactatcttgcccacaaagctgatcatctctattgaagctattcttgtggctccttgcctttcagtgttgcaatttccatacctgttttatttgttgacccactctgtgggctgcctaggaatagtgactctgtctaacacactcttgtttctcctagagtagcttatacaacttaggaatttgagtagtacttgttgactaaagattatcttctgtagattacatctctactccttctgtcatgtgaaacaaaagcatagaccattacttctaaaatcaacctttgagcacaaactttccatcaaattaaaaggacctgaaggtttttccatctgtccctgagtgtcaagttagtacagggccaggagcatatagcatggctcctgtcttcctccctagtgttttcatgatgccatcctgcatcctagctgtctccccacaggatgagtgaatcaggagtcatctgtgctatctgagaaaacagtgactgctacacctccatcataactagtagcaaacctgattagtaaggtatagatttctttctcgcttgctcttgctttgtgtgtgtgtgtgtgtgtgtgtgtgtttgtgtgtgtgtgtgtatgtgtgtgtattaaaaagttttcatggctgggtgcagtggctcacgcctgtaatcccagcactttgggaggccaaggtgggtggatcacgaggtcaggagattgagaccatcctggctaacacggtggaaccctgtctctactaaaaatacaaaaattagctgtgcgtggtggtgggcgcctatagtcccagctactcgggaggctgaggcaggagaatggcgtgagcccgggaggcggagcttgcagtgagccaagatcacaccactgcactccagcctaggtgacagagtgagactccgcctcaaaaaaaaaaaagttttcattatgggccacgcacaatggctcatgcctataatcccagcactttgggaagccaaggcaggtggatcacttgaggtcaggagttcaagaccagcctgaccaacatggtgaaaccccatctctactaaaaatacaaaaattagctgggcatggtggtgcccgcctacaatcccagctactcgggaggctgaggcaggagaatcacttgaatgcaggaggtgaaggttgcagtgagccaagatcaaaccactgcactccagcctgggcgacagagctaaaaaagaaaaaagttttttaatatggaaatttttaaacatccagaaaagtgaagtgagaaataaaattccatgacctcttaccaagcttcaacaattatcaaaattttgctagttcctacttttttataaaattttgtcattctccactttcttttgcaaaatgaaaaacatttggacatttatttctcaaaattgtacacattgatagaattatgttaaatgcacacatatattgaaaaataaagagtcattagaaggcaaaattcctacatgttaagcaaagttctgtttggttcctttcttttttctgtttagggtgaatgctttataataagtatgttctagttcaatgatggaaatataaagtaagaaacgaaggtgaactatggaagcaaatcctaaaggactctctctgtaaactcacattgcagctctcctcgttgtcaggccggtgaggcaggatgaaggaggacacagagagagggccgtcacacttgtcggcaggctgagtgaaatccagacagctggtgatgatgctgtagtagtgagttggaacaggaatggaactgccttccacgtacctgaaacaggaaggtaaaacgaagtcacagttgatgagttgatgttgaagctttcttttttaaatggtgatcaatgaatattgcctaagtcactaaaattaatccccattcaattgaatcatttttcacttctaagcactagcccacttctatgtctttgaaaataatgttttctttgcctggaatcccctcactcctcaacctggcagagtaagaaagatattccaggcaaagaaaatggattgatctaagaattggagacaggtaatggtgaatagaccaatgcagtagaaatgaaaggctggaagcgtcaataaaagccaaattatggtgggttctgagtgccaggatatggactggggcattattatttaggtagtaatgctccattaaaggtttttgtgctagggagtgtcattcattattagttccatgtttcaggaagataactttcctagagttgtataaaatggacaggggcaagagacattagagccaggagaataatgaccctttcaagctacaatgagatgcagaacttgatacaaagaactcatttgccaaaggaagtactaaggaccgagtgctaatgatggacctagaggtataaaaaatattttcctgtagagatcagtacagaaattcataattccttgcctggttttctattatcttaattttattcattttccaaatattaaaattacgatttaactactaatttaattttggctaacagtgatcagcaataaaataaatgtgcaatttacacaaaatttctcttcagaatgactggaaaagaagtaagataatttctatcttatttatctgtatttataaaatagcaatttattctgtaattatctctaaatcacaattaaaccctcttatactctgggctgctgattgtttcatgcttgtataaaattaaataacaacattctgaatttgtcaacaaatttgttgacaaattcagaatgttgttatttaattttatacaatgaaaatacatcccaatcactctaaatcttgctttctccactagactgtggggtcccttatgagcacagataatggcttttatatgcccaacagcaccaaagagacagagacaaccagattcaatccaagtccataggcactttgctactgagaggtactgactcagaaaatctaagggattcttaagtcccacccaaataatgaagataagtgggaatggtcatcttcccattgaagagctgttgaagaaatgactaaacaaaattaaatcctttaatacatttttttcatagaataaaaaagtgcatttatttaccacaaaacccaaaattccattcccaccaccaatgcccatttaatcaaaagaattgataaattcaggctgggcacagtggctcacacctggaatcccagaactttgggaggccgaggagggtagaacacttgaggtcaggagttcaagaccagcctggccaacatggtgaaaccccgtctctgctaaaaatacaaaaattagctggatgtggtggtgcatgcctgtaatcccagttactcaggaggctgaagcaggagaatcacttgaacccaggaggcggaggttgcagtgagccgagatcacatcactgcagtccagcctgggcaacagagcaagacgccgtctcaaaaaaatatatatatatatatattgaaaaattcaaaaaacttaaggggtgtcatctcttctctagtatatgaatatttgaaaaacttcttgagtgagatcttgggacttaaaaatcacacactgagtagaaatgaaacgcttactgttttattttgtcttctgtgtcatgtaagccatcatagtcatagtcgaagattggtccacttatcacgttaactccatttctttccgaagcatatttcttcaccaataccctttggaaataattccagacccctgtgcaaagacaaaaatccaaaaatcaattattcatgaagaaaactccttactctagccaaattctctctaggatgcatgctacgagccaaatctcacaagccaagagacaagagagctgtcgtgattcatgagatgaatcaattctatggcattaccagtgtgtgtgtcatttacaaaccagcaaagggaacagtgtagagctatgaaacaatggtaggggagtttaacgtagttcaaaagtcaggaaaggatcctcccaagctgagatctgaagcatggataagtaggtggtgtttcccaggcagaacacgccaggcagagggaacagaatgtgcaaaagaggaagtatggtgtttcagagtaatgaaaataaggccttactctttcttctcgtccttcatatctcatcaatatgctagttcccaggtttaagctttacccctgacctttcctggagatccagacatgttatccaaccacctacctcctaatgcactggaatacctaatattcatgtcaagcaaaagaattttaatgttccttcctaatcctgccccaaccctcgccttctccatcataatcaatggctctggcactcacccaggtgtttgggccaaaagcctaagagtcatccttgctttctctcctagctatagacacatgtgaacaattcctgtcagtgctatcaccaaagtacatcccaattatcccaaatttgaccacctctcatcttttcactgctctatcctggtctaacttaccatcctctctgagtgagctatcacaccacaaaagactattccctgggttccctgtgaaatgcttacttcccttgtaccttgtagcccactcccccatatcgtagccagacggagccttttacaccataagtcagactgtatctttctcttgcacgcacatgcacacacacacacacaccacccatttccaacactccagattatttttcattgtaattagagtgaaatcccaactccccaccatggtctttgcctacctctgtgactttacttcctacccctttccctatcactcgcaagactttcttcctgtcccctgacttttcccctaacttatttcaggctaagcttttgcacttgctctttccttcgtttgaaaaacattcctggatctgtgcatgtctgctttctcctctataattctttctcactttcactgtcatcccctgcagagaactgccttatcctcctgcttctaatttccataatggccaaccagaggggcagaatggaaatggagaaaaacaagagaataacagaaggagacaggataggcaagcaatgggttggttctgaaatattagatcgaattcgccatgctgtcttcaacatgggtgtcatgcggttctggctgttaacccctcttccctccccttattaaaaagcacctggccatgcttctcatactgcttcaattgctcttcctgccttctgaaactctgaatggcagagcagcccacaagagccaaaataccttagataattatttgcagtcaagaaagaagccagacagtaagaaaggagttcaaacgttaacttaagcattaagaaaaaatggagaggaagagaaggaaagaaacaatgagaacagtcaaaaggccaggcctgcagaaatgtggcatgtgaaaaaaccacccccctcgtggagaacagcaagctctctatgaaaggccttctccacaccagcctcagggtggtactgtgtgttgccttgattaccatttggtcaaaaaaacacatcaataaagaataaagaaatccagagaaccctgatttgcagaaattaaatgaagctgcattctatgtaatattgtgataaatgtaactatgtgagtttctgaaatgcttctcagttgggtctgagaacaaaccaagaaatctttttaaaagcatactttaatttttcactcataagcaataaattctctttgaataaaccttcgtttactaactaggacatcaaataaacatttttttctctaaaccgtgtggcccttttcaccaatgttaagctgcggaggcccgccactgtagctgacactccacaatcgcccattcctattttgagactccctttcagccctgagagttacataacacagcctgaacctcctccatcaagttgaagcacatagaggtgcttccttttcctacctttcccataacgatttaagttctgttcactacaaatgtactgaaaggtggtaaaagctacttcataatgcttactctatctttgaacacatggatagataaaaggatggatgggtggacagggggatggatggatgaatgaggatggagacatagatgaatagttaacagaaacaaaaaatgcagtgctttcgacattggataattaagtcagaaatccatataaaccttagaggtcatgcaatcatatctcttaatttcacaaatgagagatttaatgacatttctatgatcacacagcctgtggtcacactccaggaacttggctttttgtgcccgagctcattgtgcctatacaattcttgacttcaccagcatccacaaatatttatgtcaggtacaaagaaattacaaatgttcaaagaaactaaaataattggtacaggactaaaatcatctgaaataaacactctgatgattcagaaggtcctttcggctcttgctgggtttcagggccaacattcagaaaatgttatcaccccaagaggaagaggtgctactggcttttactgcaatgctcaacaaataaatatagatgctgttaaatatcaagtggctttcaaaatatagtgaagaccctttttaaccattaagataataagtattgaaataaaaataacaaccatattagaagaaaaacacaaacttgggttagttcagtttctaccatgcatgacctgtggtcactttctgtgatatcaatttcttaattataaaccggggataaactaccagccaaccttcctcacagattcaaattttggatcaatgtagaaagtttacatgaaatcaaagtttacatcaatgtagaaagtttacatgaaagatcctcaaaaattataaaggttaaacacatgaaaagtattcttattaaaattaacagaggtagaaaaggtaaggggtaaatttagaaatgtttattttcataaataacagtgtattaggtaaatattggacttacgtttgaaagcaggatacattggaaccatattggttacaaggaatgcatcatatttagcctctggtgaagagctcagatctaaacattaggaaaacaaatagtatacgttgcttaccaaaatctatatcagttaaaaaaaaaagggagaggggggtagaattttcttaaatggtccaaacaacatgaagtaaatgaatctactcttttattcctactcctaactgcgttatacaacatgtccttactcccctcccactcagtctcttcttcactcaatagctctctcccaagagccatttacaatgtttttttcttactgtctacttcttgagtctaccaacattatgtaaaataactccttgatttcatcagtgccatttagacttaaaaaaaaatcatcaaggtaatgagagatggtttaagggcttcagatttttttttttaaatatggaatcttgctctgtcacccagggtgaagtgcagtggcctgatcacagcccactgtagcctcaatctcccagatttaagggatcctcccacctcagcctccagagtatcagggactactggcgtgtgccaccagctcagctaattttttaatttttttagagacaaggtcttgctatgttgtccaggctcatctcgaactcctggactcaagcaaccctcccatcttggcctcccaaagtgctggaattactttgggattacaatggtggctcatgcctggcctcaagcaatcttaagagatcccctctatagtattacataaacgactagtgtcttaatgattcactgtttccttttcagattctcatttaataatgtaaggcgggacacagaagattcccttgcacattagaattcccctggagaattagatttttttgaaagctagtcactttttggctgattttggaaggatcccataaaaattcatttagataatcttctgagcaccctctcttgaagaaaacccaagccactgaaattccaaataccaagattgcacaatgtgacatccctctgaaggcatcagatcttgatattcttaacttacaaggaggaaagaggaatccgtaggacatctgcttatcatttttgtaggccaaacagttctgactgaaactcggagaaacacggacatcaggccggacgcaactggtcagatggtcaggaacgctggaaacctcagcctgcacgggagtcagaggcactcagcaatgccgtggctctgttacgaacggctgaaatcaaaacccctctggcttctcctatgcttgtattctgattgatagtctgactccttttttaaattttttatctttgatagtctgacttctttttaaaagtccttagttttaagtacagtaagccacaagttttcaaactttttttaatcaacataactctctttatcaaagtcttaagaaaaacaatatagaaagcagaacataaagcagaaatcccactgttgaaataataaatagaatctcattgaagataacttataaaataacactcttacaaacaatatagatgtatctcctctaaatagactatttatctgtgtgtgtgtgtgtgtgtgtgtgtgtgtgtgtagaatgtacaagaacatacgtatgtgtacacagtacaaatcaaaataaactgtatttggggcagtagaagtgttctcctcctttgtattaaaaaattttaaacatgcctcaactgccaaataacattttctaatttgtgatatatacctatttatctcatcttcatcaaaactgaaacccccaacataaaacttttgttaaaaaacaacagggccaggcgtggtggctcatgcctgtaatcccagcactttgggaggccgaggcaggcagatcacctgaggtcaggagttcgagaccagcctgaccaacatggcaaaactccatctctactaaaaatacaaaaattagccaggtgtggtggcgtgcatctctaattccagctactcgggaggctgaggcaggagaatcacttgaacccaggaggcagaggttgcagtgagctgagatcatgccactgcactccagcctgggagacagagcaagactcggtctcaaaacattagaaaaaaaaaaaaaacagatgctgatagtgggggaggttgaaggggggtgggtgagtatgtgggaactctgcactttacactcaatcttgctgagaaataaaatgtgctcttaaaatataaagtctattaaaataaataaacaaaccttggcagtttctgtaactattgggcaatgacttaggcagagtaaaagaaaataaaagaattagtgatctaccttcaaagtttaacatattcccatggaattaccagaacattgaataaaggctaattcaaaatatcttacaataaatccaacataggatttctgtcattaagaaaaaataaaatattttctaagacaaaattctgttaagcaaggaatcattgtattaacatgaggaatgtaataaaataaaaaatataaaatccaattttctcaatgacctgtttggaaacagtatatgatgtccagagtggcattaggaatatttcactataaccactttcaaagtcagtgtgatataagatatcatatctagtccgataaagcactgcaggtcgcccatagaggaggtgtctctctaaaaaagaaaaaaaataaactgtgttaggtgcatattaaattttacatcaaatgttaaagaaatgttggaagagtcaagttacctaaaatggctagcttacttattattaatatagcaccttctccttaatttaatcaagctagttttcctaacacttttgtggttgatctgatcacctaaccatgggtcaagctttacagttatcaaaaccataatgtaaatgctgtatttacagaatgctttttttagttgtaaagaatttacaatttgtatataaaggaaacattatgtaataaattttgaaatgattcagctgaatggaaagccaataggattggatttctgtagaattaattattttgacccctgaagaggcttatcaggtacaccaatgatttaattaagaagaaggcacacattgatcattatatgcatacagcaactcaaatatgcattccttcagcataaaaagtgagtagtaatgagcatttaaagtaagcagctttgtcatacagaggaaaagtctttaggtaagaacttaaaggaacatgtatagataaaataagtgggcattcaagagggtcttctaagtacagaagagggaagttcatcagttaccaaagaactcaatgaagacccccagtgcagattcagacctccaaaggaaagctctcttcttaggaaaaaaaaaggtctgaagctttactctttgcggaagaagagatgggagttcagtatgaaaatcttcattccacactctgcaataaatacctggagcttgatctgcccactttggataggctaaagtcaaaacttccacagattcttggaaatgtggggccctacagaccaaaatatttagagactgaggcttaggcaattcacaattccttaagtgataaatttaaaaaaaaataaattcttgtactattttttctactagagaaaatcagttctgaaaaacacttattaaataatgtatacatgttgctttaattaaagtcttaccattctatgcaagtaatggagaaaagtcttcgtagaatactttgcaagaccctcccagatagaactgcggatttgagacaaagcggcccacactattacaacacaagcctgttctgggtagttcggctgctccagcattgcagtaaatgtagaagccttagttaagctgccaaatttggggacccacccctaaggattagaacataatctgacaatattaaataaatgaaatataataaacaaataaaacaccagcaaatcgtaacagtagtacttaggggcagtaaaacaacccagactttccttcaaaactcaaaccaaaccttttctaggttcaaaatttccattaatgttttccttgttttcatttctgctgcctctgaatttcctggtttcagctggaagcagaagtatcaaaattctttgagaagctattctcttttcatcatttaagttttcatggttaccacacacagtcctccaaactcaaattcaagcttggcatctaatcgattccattaggggacaataaaatagcagccatgttcccatacgcaatacccctccctagagcaaccaccaaacaaaaatcttggacaatctatagtctctactaactctggctcttcctctaaatcctcctcatttctaagcattcaacgtaacactctattccacaaaggctaatgtatttgcaacactctcttcacaattgttgttagcaacattacactatcatatatgctatttcctttctctctaccagaaataacttctccagtcttcgccaagtctgtcacctatctccttccaaatgtatccattattcttcatcatcaaacattgagcgccttggttgtgccagaccttgcgctgtagaatggaggtactgggcaaagatgattaagatagagctcttaccctcaaagagctcacaagtcaaagggagagacaaacatagcacaaataacagatgccatgtggtctgcaccatattaaagatagttacagagtgtgatgggaatgcagaggatgatgaatactggaaatggagtgaaggtggcatcaataaagtcctttaaggagcatatgaagttaaaccaggctggccccatgttacagttttatgcctgttgccctggtataattgttaatagtgtcccttttcacgctcaaaagtgtatgacaaatattcagccctcatggaagagacatgaagaagaaagggcgaggggcccaagaggggcagagatatcttaagattcattttctctgccgggcatggtggatcatgcctggaatcacaacactttgggaggcaaaggcgggtggattgcttaaggtcaggagttcaagactagctggccaacatggcaaaaccctgtctctactaaaaatacaaaaattaaccaggcacggtggtgcgcacctgtaatcccagctactagggagtctgagacaggagaatcgcttgaacccaggatgtggaggatgcagttagccaaggtcatgccactgcactccagcctaggtgacagagcgaggctccgtctcttaaaaaaaaaaaaaaaaaagattcattttctcctgaaaggtttcctcaataaagcttctccatctctactcactctactgctctacatatatagattcaacttgcttcagaaatttgggttctggccaggcatagtggctcacgcctgtaagcctagcactttgggaggctgaggtgggcagatcacttgaggtcaggagtttgagccagcctggccaacatggtgaaaccccatctctactgaaaatacaaaaattagccaggcatggtagcacacgcctgtaatcccagctacttgggaggctggggcagaactgcttgaacctgggaggcagaggatgcagtgagccaagatcgtgcgactgcactccagcctgggcaacagtgcaagactctgtctcagaaaaaaaagaaaagaaaagaaagaaatttgagttccatagcttccaagctattgtcataactgcaagttttggcacacagctggaacacaaaagtatcactgactgcctttttctcaattattactgagcaaaaatagcataataaggggaaaaaatacagtggtttttacagcctcctaaaaatccaaccaaggtccccaatgacccaaaaaaatctacttgggtcttcctggagcttaacagtttcatctaagaaagagggggaaataatctctgcagtaagaaacacagattttaaggtccagaatcaaaatttagattttattttttcagtttatcaaagtatcaaagaatcacagattcagagtcatagcctgactctcctagtctttatgacatcttgggggagccacccactgcatttttgttgagcaaaaagtctctctactcaggccacaaaatgtacttgaatcttgttctcggcacacattgagatctttatctcgagaccagcaaccctggagactagcctgcaagcctctgcttctgcaatatgtttctgggatttcttcacgtggatctagtataacctggtcttcccaggctgagaatgcctgtcatggaattccagaccgagccttcattccacaccccagttccctgtttacaatagtgtctctggcagttttggtacatgccaaggttctcctccagataccacacttggcaaaatactgtgaggccaatctttttaagtggtgtggacttccccagcactcattctttttgtattccaaatttgggtcgtagagactggagtttgtgttccttttccctcctcagcttcctgattcagattcccacagatgagcaggctgtcttgagagccacatgaaaatctctcctcttttttgtttttttaaaacatacactcccacaataatatgctcttaaatcttaccacaaaatctctacccaagatctttccttttcttgcatactttctcctttgccttacaagtgcctattatcatttgctgccatttcaacctcctctgagatttgatttaaggcctctctttagtgccctgttctttcttaccccaaccttgaaaacattatgctgtaatgtatcaactggataaatcctacaacagaacaataactttatgaggacaaggacttcatctgttttactcaccactgtatcttccatctccaacaatgcccatcacataatatctacttggcaaacacttgttggtaagttaatgatacatattttttttaaatcttggctttctacatatgacctgtctaatgttaccctgaaaggtacactgggcaggtcagtagtatcatctccaacttactgatgaaggaactggaggtttatgatttgcacaaaataattcagctgcatagcagcactagaatcccaggccattactcttctgcttggccttttgggtggtctccagttgggtgctggccgctgggttatttcatggagagtgtatgggaaagaagatccaactacttcccggcaggaactctgcccgagtaatgcctactgagaagctaatgaggacagtagtttctgtcaaagcatctagtatttcagaagcaacttccaaactttgatatacaaattttttgttgagcaaagagtctctctacttaggccacaaaatgtatatgaaaagcaaaattttcttttgacatattccctttgttcccactcttagaataagaagcattttcagatgaaagcacatgggcttcagtgtcatataaaactgcgttcaaatctaatctcagctctttatagttgtggtactctgtaacttaatctcccaaagctttatatctccctggaatgttgcactgtttacaggcaaaatatgtgaagtggcttgtttagttttaacccaaagtaactgcagttgtagcagttgcagttgtactgtttagtaaaggtatgggctctacctcaatactggcaaagaatattgctaggtaaaagttgttaaaattcaatctaccatcaaattcatcttgaattctactataaacaataaacaattactatgtattgatttcttccaagtattcccaaaaacacacagatacacacgcagacacaaacactcagaagcaggagtgaatgctatctccttctttctctagaacaactaatatctccaaagaaataacacaaatgagaaacattccagaattgacaagagctaaagaagatgttccctctgtagccatattcaggactctgctttaaagttaacaagaattactagtgtttaagtcaattttctttttcttttttgaaacagagtttcactcttgttgcccaggctggagtacaatggcgagatctcgactcactgcacctccacctcctgggttcaagcgattctcctgccccagtctccctagtagctgggattacaggtggatgccacgatgcccagctaatttttgtattcttagtagagatggggtttcaccatgttggtcaggctggttttgaactcttgacctcaggtgatccacccacctcggcctcccaaagtcctgggattacaagtgtgagccactgaccgcacccagctgtgtttaagtcattttcctatccaaactaacttctcattgtgtatgataaggagccaagtatacataggtgttaaaattatttttaattcctttttcacaaagatgatggtgagggctaacctaagaaaatatgaaacatttttatagcaatgtaaatagagtaaagaccaaggtgaaaataaatggtgcaattattcttgcagtgaaaattatacttggctatagtgccagaattgcttgctacaagagattttttaaattttcttttcattcattaattcatccatcaattcaatgccacaaggaaatgagttttcattgcatggaaagtcggccaagacattaggtatatgagatccagaaataacaacaggcatgcaattaagacctggagtctaccacctatctagaaatattaaagtttagcaagcagcttagatggccatttttgaggattacatttttctttctctttattttagtaaaggatttgattccataacagtttaaatatttatagcaaaatattgcccaagattggtttaacatacctcttttttatcacagatatccctgtgatcgtttcactattggaacatgcagcttttactcatgtattttgtacagatgtatgacagattttacagcatatgccattaaaacagtcacatataaatgttacaggtgaagtgtgtatagctcatgacatattctgaaaaatatcaactacttacatctgtgttttaaaaaactaataataaaaatagtacaactttacatctgtatagaagtttaggtttacaaactactttaaaagccttcatatgtattcaaaggtacctagaaaggggaagtaattgccctgaacataatacatgtgtgctcacatacatggtggttcacattcacaaggatctcctccagtagggcagacactgaatattttaaatgggaggccaaatttatgacacaggaaacaccataaaggcctgaaagaactcagaccaagaaaacatcgctttgccactgaagaaatgaccaagatagagcccaaaaggaaacaaagcccaagagacagcgataggagagagcaacaggagaaagagcattgaggtttatacatattccagcatctaagcaaggaaatgcattgcacataataagacaaatatttttgaaggctctcttgtgtcattaaatgttggtgccactaggccatgagcagacttagaatagcatgagctattctagattcccccctaatattttatgccaccactttgaagccatgaattagaaactctcagtggtacagttgtgtcagagtaaccagtgccagcccagtgtcagtattcaacaaatgcttgctgaatgtatccatgagggtttgtttccatgaaaatacacaaactttaagcttcagcggtataaaaagacacttcagggatttaagtaagaaactcacgttccactcagagcagagcaatggagatgtaaccttactaactatagctccttatagccctgagagtcagtgattcactaagaagatgtgtcttatttttatgctcttaagtttgaggtgattgtgtgtgtttttttgttgttgttgttgtttgtttgtttgtgagacagtctcgctctgtcgcccaggttgcagtgcagtggtgcgatctcagctcactgcaacctctgcctcccaggttcaaacaattctcctgcctcagtctcccacgtagctgggattacaggcacgcgccactgccgcccggctaatttttgtatttttttagtagagaaggggtttcaccatgttagccaggctggtctcaaactcctgacctcaggtaatccacctgcctcagcctcctagagtgctgggattacaggcatgagccactgtgcccggctgaggttattgtttataatgaattgtgagactggttttgtcatataaggacactgccaccaacaaattaaatgcaggaatgtttttctcagacagaaatgctttagtaccatgaacagtcagactttgaatcagcaaaatcatgggagttcaatagaagttaccataattaatttcattagtgacttttagaagagaagcatctgagtagtatttatctgccttggcaactaaatatctaaaaaacttgaatcatgagactccccatcttttgactctagcaatgttctaattgttctaattataatgacactatagtccactagaggttaggtgtcgaacattgcaaatcacttgtagagtttgtgaaagatttgtgtgccttctaccaacaatggcctatcttcaaagtgagattcattccgttctgtgccagagtctgtgtgttctgtgatcaaagggagaagtgggatgatggagatacagaaaaggaagaaggaggcagatgaagatctttaaaagaggaaaaataagtcaagtaaatcaaatcttctaccggtttcctcaactctacttaatcagattggaaagagcatatatgataaacagaaccatatgtaagctaataactcaagcgatgctctcaggagaatttgaccacgtgcatctttgctgcatgacttgtggctgctatgcttgaattctttctgcattttccatacacttttagtcatttcctggctgtttcaacatgttatcccatctactttagtaacatgtataggaggcttcccctccccttctattttcctccaattttgtgaaacttcacaatcagataaaaagagcctgcatggtagattgtgttattgctcctcattatttactgcctccacccattgccatatgacttgcaggatagagtccccgtggaaaaaatgtacttccctacaccattggtatcatgtgctcagctttggccagcaaactgtgaatggagtgacatatgcctcataaaagcagaagcattaagacacagtgcacagttctgccactcttttccctctgtcaagagcaggacatgtctctgatgaaggctactccttcagcctgggttccagaataaagaatacacatggagcaaagctgcccttggcctacagccagcacactaaaatgggagcgagaaacgcctcttagtacaaatcactaatttttttttttttggtcatatcataagcttgcgaaagttcactaatacgtgctcgttatcattgtacgtaaagtaagagttagggcttgagatgatccttcatatgaggagggagttctgatttgattccttcggtgaatctctccctatcacaatatatatatatctatatatacactgactctcgaggtagataccttcaggataggcaccagctgctattatttatcattgtgactatcattccctttataggagtgccccacagtgtcttatgactcatcagatacaaaatggattgtgtacttttcagagggcttaaaagctattgaggggggagaaaagctattggaatttttttattacacagctggcatcttgtgtacatggaataaacaaatatcctttgccagataggtatgaaagtcactttgaaatacaaattctaattttaaacaatattgtgcttacactataatgtaaataagaagccttttcgattttcgaaaacgagaaaaaccttatctgattattttgcaaccaccccttaccttctgtagacccttttgtatgaagccgtttgttgagttcatccaacttgttcttcatgtgtgaaaaccagtaaaggaaaaaagaaagcaaatcagaaatgttctttccctctgtgcccttctgtcgacttagcaccctgctaaattcaaaagcgaactctaaactccatctatatcatacattctttcgaggaattaactgttttctctcaaactgacattctgggctccacctctagcagttctatgtttgtaagcaccttcttcaatctctgtttccttccttaaaactgtggatagtcaccacagtaccaatttcccatgtgggtactgatgatgacttgggcatatatgtgtaagtaaattaggatagcgcctaaatgtttcagattaatctctaggcacactgaagtgattcccaaactaatttatgaaatcacttttcaccaaagctaaaacgtaatgactcagcaattctgaaacagcatgagtcagcaactctacccttcactgtataccctagcatatgcgtgcaagaagacatttccagtaatgtctgtggcaacattgttgtaagagctaacatttgcaaattactaaatgttctcaagtaggaaaatggaaaaaaattcttatggtacatttatacaattaaatattaactactgtattagcagtaaaaataagtgagctaaaacttcatgtactaatatacattaagtctcaaaaacataatgataaaataattgcaggatacatatagtataatagcatttattaaaaattttacaacatgcaaaactatagtataggttattttaggaaactatacaaaagattacttcatacgttatttaataaatatataaggccaggcacagtggctcacgcctgtaatctcaacatattgggaggccaaggcgggtggatcagctgagtcaggagttgaagaccagcctggccaacatagtgaaaccccgtctctactaaaactacaaaaattatccaggcatggtggcaggagcctgtaatcccagctactcaggaggctgaggcaggagaataacttgaactcaggaggcagaggttgcagtaagccgagatcacactactgcactccagcctgggcaacagagcgagactccatctcaaaaaaaaaaaaaaaaaagaaaacctgtccaagcatagtgtgtgggggtagtctctgtttgcaccaccaccgcatccttgttgcaccctcccacaccctgctctgtggcctgggaggctgacctctagggatggcatcaaagagcaaacttgccctgtggctccctgttgggctctaccaaggggaaacatgtgaaaggaagtacaggggaggaagatgacggtagcactctcctatctgggagtgctccctgctgggttgcaatgaacaagctgcactcatcggccaaatacaatagttccttcctattcggttgtctctccatgttttggaaacttactccttcccctcaccctttaaaccttagaaggtactatgcgaaccccagggcacttcgtcactcctcattgaattccatccaccctgctcagccttggtaaattactcattaaacatgactgaaacaattcctttaaactctctctttttttcatttccttttttttttttttgagtcagagtctcactccgtcttccaggctggagtgtggtgacacaatcccggctcactgcaacctctgcctcaagcgattctcccacctcagcctcccagcgccaccatgcccggctaatttttttgtgtttttagtagagacagggtttcaccatgttgaccaagctggtctggaactcctgacctcaattcatccacccatctcagcctcccaaagtgctgggattataggcgtgagccaccatacctggcctaaactctctttcaaaacctcttctatatgggccacctgtctcccgtcgggaccatgactaatagacatgtgatccacagttgaagaaaacagaaaaagattttggttgagaactgtgactgcacagaatagcaacatgaattctactttttgtctttcatggtctatacctgtgctattcaatatggtagccacaagccacatagggctctttaattataaagtaatgaaataaaaatttgagttcctcagtcacactagccagtagctaccattttggacagcataattatagaccatgtccattgtcacagaaagttctatgggccagcactgttagccacccaacaaacttctccataataaacataaagattatttctacctttggctctaccttatcatcacaagtgcagcccaggtcaaaatcagactgaaggtacataatccctggataattgggtctggtaacttcctctggcatggttggcctgaaggtattagtgcgcaggagatgattcaaacttccatgggtcccattattaggagctggcttcaatcccaggagatctaatgaaaattaagaaaaggaggcaggtgcttcttatatttttttgatgagatatggtaagatttaaaacccttcaccttctatgggtctgaaaactgtgaacacaaatcagaactggacaaaaccaaatgtagatggcaggcaccccctccttacctcctgaaccattctggactaactacatcttgccacagctttctgaaatacccaagttcattgcctgaccatgaatagagagagagagattcccagaaagaaagagtgaaggaacaagactttgattaactattgcctgtatctgcgatagttacaacccaagggtgatcaatgtcagtatcactttttcctgcacttctctgggactatttaattccatgttttgaaatgagacttataatcaataactaactagaagtctgccctctaatgactccacagaagtgtggggacatgaggaggctttggccctgtcccctgaagtgccactgagcaatgaacaggctgatttcatagcaagtgaatggttgccaagtgcgtattcagtaacttgcttgagctcagaggcaggacaggggacagctagcagccaagatgggaaaagaacccaggagacccgacttgcagactccccctctaaccaccagactggcactcccttactaaataggaaaagttgtcctcattcagcaactagaagttcaaggaagaaaaataattaagagcacataaatagctggccaggatgcaagctggcaacatttttaactgggctgcaatgcaagagatggaggtggaggggactctgtgcagaactcttgcttcatcaggtctctgaccagtggtgtcaaactgtaatgctatgttagaccagccagaggctgccaacagcaacactatgaaaacgccccattagtcaactgttgaaggaagacaaagaagccttagaaggggataatattctgtctttgaaccaatgggcaagttacaaccttttgtggggaagaggaggtagtcccagaaaatagacacctcatttctttctctgacattgagaaagatcatatatactaactaaagattgtttcaatggttctgattaaatgagtgacttaccacacataacattgtaaagttcaatgttttcaaatggaggcactttagtcttgtacttaaatgttgagccataacctacaaaaacagtcttccaaaagaaaagaaaaacaaaaacagttaagcattgttaggtaggaacccttcctctatttatgaatactgtacaacttcactcacaccaccattacttatcctttcgaagaaccactaaaacacaatttcaattcacagttctgccatcatacctgcatgctgttgaccttgttatcaaatccgtggtctccctggaaaaagcattttcctgatggtttcttataaacatccaaaggtttcctaaattgaaacaatttcatgattagttagaatttctcatgaaattactttgataaaaaggtaatttcagggtacaaagaatatctaagaaggggcttttgaaagtttgcctctattttaattgcattcttcttgtgatgatgaaaagaggatcctatgcatttctccaagtgacttttctttgacagttattgcaggataaatggcgacctgtgaactgaagtcacgatgccctccttggagctcgtgcttacaccaagtagggcacttgtcaaaagtcatgctctgcctgtctaggtgcttcgctagctctgagactgtaagattctcgactctaggaccatgtttgtctggttcacttctatgtacccctccctagggtcagtgtcaagacatagttggcactttaaaaaaatgtgatgtctcacctattatatacccataataatttaaaatttaaaataaaataaatttgcgatgtttaaacaatgaatggagatctatattctataaaaatatttgcatgcaaatttatctatcaatatacaatacaactagagtacaactaagcagccaacttaacagtaatcatgacatatctgacaaaagcatggtctcacctagacaatatctctatttagaaacagaaaacagaaatactgctctctagacatcaagaccatctgatctttccttttgtgacagaagacaccttttgcaaaagtgtcatgtgacccttttccaaaatagctttcatgttaatttaatacaaatatttcctaagtacctatgggtatatagcactgaaagtgctttgggaaaacaaaaaatctaacatacgggtctccacccttggaaaaataagggcttgggataataagacatatgcatacaatacctcaacaatgcaagatgagttaaatttaaaagatgcattgttaaccaacatgcctggttttgggctacactaatttgcccaactgtcatcatctttcacttaacttctactcagctcccatgtttttgccatatgaacctactacctgcgccagtgtgaccccttccaagctgccccatacataaaaggtccttcaggagcacataccgggccaattaatttcagtcacatcccaattaatttaccaggccagtaaattctccatgaggatttcccacaactgttttagaagactccaataattcctgttcttcgtacatctttcttcataatcccacatatctaactctaagtacaccctggaaaattacagcatgatatttatgtatctgtcaaatgtgtctctctaaacatcccatactgatacaagtttctagagttctaagttcttcttagaacttgagtttctaaatattttcttgttatcttctttctcttgcaaactagtacccagctagagtacatgtggcagttgttcaattattgagatagacaaattcacagcacttttcttaagtagaaagttggagcaagagtgagtgggaacagctacttccaggtctgtgtgaaaatggataaatccttaataattaactcattggaagttgttagagcctccagacatgtcctagaccacattcaaaagcaaggaacattctcttcaacattggagagtgttttgtagttcaatagaaggcaaacattgggaatatttaaagcaatgtaaaaagtgcccacaataacagagtttttaacattaacaacattttctaaagtcctctataaatattgctacaagcaaagtctcaacaaccgagatcaaatcagcccaatatactaaggcaagctcccatttatacttttgacttactcaagtagtaagaatagagtttagaatgtaaattcaaaggatgaaagagacacacacacacacacacacacacacacacacacagatgcactgacagactgcaaagagacaccacaatgctgagacccagaacatagagatatattgtctcagcactgatggtttatgtagcccacaaaatctttggaaacagtgagatttccaactgatatttctttcagtgatgactaaggatgataaaatatttccagttgccaaaggggtggttgtggaaatgagaaacagaaatagcccatataccagttaccttgcaacatgccatctgcgttccaccaataaatggatatcctcaattcttctgttgttggcatagtgcaaacgtttgggaaggtgctgtttcaagtaaggcttaaagtgctgatctggttttttacactgaaatagaaatggaaatcagacttcagatggaatgtcttttggaaaaattcttacaaattctctctctagaaagctgaaggagattttaagcctaaccaaaggttaatgagtgaataaatgaaatttatttctattaaataatgtatgctgaaaacaaatagattcaaaagagattaagtaaccttggagatgatatgacaggctatctgaggacagttaggaattttaagatgcattcctggcttgtgagaccatcgctaagagcaattcacactccaaggcctttcccaactccttcaagtcaagcagttgggggtggggtgtcggtgggaggggaggagcacatgggtttaggcttatctgattagatgctcttgtaccactaaggtcgctacccagcatccgggaacaatggagcagagtgggtgggcagttctggttcagggaaagtaaagatttgtttaaccatgaatgaatacttttcagttctaatggaaggatcagatattctccatttgtatcattgccaagaccattagggagcctgcagctgaccacaggccagaagttttgaaagttcttaaggaaacaaatatacaggatggcagggcagtgaggaaagtgttcctcccacccctccccgccgggggaggcacacacaggagggaggctgctccaggggcagaggcctgggcagggcagaggcgggacaactggaaacacttaccgtgagattggcaataatggctttggggtcatctgttcaaagagaggagaaagatttcaaaagaaataacaaccattaccaagagaaatcatttttgcagcaagatactcaattctttctccttccatcccacagaagactatcactttagtgttttgtttgaaagataaataattgtgtaggggtatttaacatttcagtcattgacatgcagctaagcaagtggaacaaatcctatagtaaactgccctcctaggtccagttctgctcttctggagggaattcctccttccatagcaccaggatactgctaggtaaattgcttcttgttttaagttccccctaatggttccccttgagacataatttatttgcagtttgacctcaggaactaaactgggcatttggggcttttaatgtaacttcttatttatctgcagatttttgaaacaagtcttcacccactttaagttgaaacttctaatccattgagttatttttttaaaagggagtttgtttccctatttatatcctgggtgtaattacacaggtagccgcacctctccagccatagacacacacgtgcatgcacctcctttattttcaatagcatcaagtaaaagattttagtcaatactctgaactagctaaaagcaaaattatgtaaatgatggctgtgcataaactgtggacaggattatattatctgaagctccccttttgggcggaatgtggggagaaagaggagattgtaggttgcttggattttgttttgttttcaggaagtttgcttcagtatgttattacagaatcagcagaaaaggaaagtggtgttcagaagagatagcaactatcatgaggcagccctccctggcatctaaataccagtggagcaggccttatctgtatcacgtgctgctgcatccctgggcctgttcagagtagacactcaatatacatttgttaataaatatttgttcatatttgttaaaaatgtatgaataaacttgccttgggatataaatatacagactccaaagtctattttcagaatcttagctctaaagcttgaaatccgaaactaaaatgtgtattccattggccttaattacatctcttactagaaggcaaataagtaataatgtaataataatagcccgaatagatttcatactatgtgcctgtctttctataagagctctgcaggtggccagatacagtgatgcctgtaatcccagcactttgagaggcaggggtgggtggatcacaagttcaggagatcgagaccatcctggctaacatggtgaaatcccgtctctactaaaaatacaaaaaattagccaggcttggtggcatgtgcctgtagtcccagctacttgggaagctgaggcaggagaattgcttgaacccaggaggcagaggttgcagtgagccaagatggagccactgcactccagcctgggcgacagaacaaaactccgcctcaaaaaaaaaaaaaaaaaaaaaaaagagctttgcaggcactttctctctggtcattcacaataaccctaggaggtaaatgctgttcaaatcctcactaagccaatgggttttcagaaggaggaggagttggcactctgacactcaagcaacctgattgagcaagccaggcctcataaatcatattcctcaaagggacgaaataaagtaagttcatggtctttgacaatgaagagaagtaaatagcatgtactcagataagtcccagagaattactaggaatatccaatgcctgagtccatactggggacatcaatccttcaattctgaagaacttagtctttgcaggctaacagtcctcattttgtgtgaagaaagggcagtggttcagctaatctggcttcaaatctcagatctgaaacttactaaccatcatcctcgaagctagttccctcacccctctctgagcctcaatttctactgtctataaaagggatagtgatacttatcacacaatgctattaaaaggattaaataagagtgtatgtgtatgtgtgtgtgtctctatctgaaatagtggtatgactaagacatcatcatcatatccaacctttatatagctttgactatgtgctaagcactgatctaaattatgtaaacacaatctcttgtttaatcttcctaacaatccttaccttgcagatgaggaagcagaggtacagggcgtcacatggtgagtaccgagcagagctgagatatgaacccagacatctgtgcctgtcaccaccccatgctactgtctcccacaaaatgaaaccacattggaaagtgtttttgtaaagtacaaaaatttttatcattgatagttatgaattcatgggccatgggaaggtttttttttctcctccaaaccaacctccccattacatgtactaatgtcagaaatattgttaaaaatagagaaaatcttttttgcatagccctgaagtgcaaatactaaaatcgaggggtgccatagtgactgcatccagtctatgcgagggcagaaaagggaggacacagggacaggaaaggtcatggaggagagagggcagaaacacccacattttgtttatttcacaacatggtctggagctgaccctggaacagttccagttgtgttgactcaggaacataattagggaaaaacttaattttccaaagctgtaaggttggtgtcaatggtttcttattcccaaggctaaaaactctaaagaatttttttttcaaagtgcggcataaccccaataaaactatggacttctcaaaagctaggtagacagcacctaaaaatcttagtccacaaattaagtttgtatcagtggtagatcataacctgaacatgtaaaacataagtgacaagattattcctgtttatttttatttctaatctttcaggacagctgccacttcccaagggcttaatatcttttcctactaggttctaccaatcacttttacaaagagaatggactccattccacaaggctcctaggaacccccacagtccaaatgtggttctgccaacccttacatagaccctctagtttcatctataaaaatgatcagcctgaacttcttattgaaaaaattcttatcttataaacttctgtttatggtcatgaatatgcttcaaactaagtgcaatttccacataataagaataagagcaaatatttatataatgctactatgtgccaggaaccactctaagcaatatgcatagattaatttctacaggtagctgctagcatttatcatccccatttttcagatgaaaaaactgaggcttagagtctaaatgacttatttaaggtcactcagctaagcggtagcagagccagaatttttacccaagtatttcagctttagaaaacaagcccttacctattcctttgtattaccactctaaccacttaatattttaagaatcaacttacatttagcattgttgctaaatttggatcgaattcttcctagagttccaggcactaaagtaatatcatccacattagttaggtaattactcaagaactcagttctatcacatgtgacatcttccattcctatggggagggagaaaaagaatattttcaggcaagactaaaacgaaaatcttaacatagacacgaaagataacatccaggcatctctttagttagtttttagtaacttaatgggaagagccctgacttttgagatttttgtatttgactttaaatggtttaaggcttctctgtataatcttttctctagacttttacttagccatatcatcttgcaagcactagaaggttgaaagtgcattacctcgattacattttaagtcactcagccagaatagcaagacaaaggaagtcaccatgatttaaacaacaacaacaacaaacataactattgacagagtctttatgaaaaagatctattctttaaaaaaaaaaaaaaaaaaaaaccctaggttgcatcaaactcttcccagctgggggtggtataaatggaatatacagttctgtgtctcttttacaaaatgtcattttccaactctctaatatatctcctgtcttgagtacataatcaccagtcctcactgtctccactggtggccttggatgttactgacaaaacaatactggcaacaagagatgagaaagaaaaatgtcagttccaatgaccacccaaactgaaaaacaaaataacactgaaaacaagttgtaaacaatgtaattagtcagaactgaaagctagcaactaaagcaagaaggttctaggtagggaatttttttaaacaacaaatatttctcctccaccccaagatttgttgtgtgtccccatcaaggaaaattcttttattaaaatgcttttatttaaaacattgttgtaaactcaaatcttagcatcatagactatggaggctactagagatcttattgaaatgtatgagatgacctggaacgttttaatatattgctcagtacaattcagtatgtacatattctctaacagggaaaataaccctgttggagaatactcatatatttatatcctgtaaaggatgcccaaaggttttaaaataaggaaatacaacccagagtaccccagatctggtaaaatttaactaatcacctcctaggatcccagatccagaaccttcccttgtttaatacaaattggaatgaaatgcaagaaaaaacacacagcataaggattatatatcttgcactttaacagttaaacccttaggaagaaaaatagagcaatgaagagctactatgttttagtacaatgttagcgtgggaagggaaagtccccaaatacctattaatagagggctgaaagtctttcccatttgttatatttctaggaagtcccttatgccaccccaaatgtgagcaatctcctttacttttgaagtccatcaggcactatgctaagtgctcctcaagcgtcatcagccttcactctgcagactaactttgtggaggggtgttaatgttctcacctgacagatgaggaaactgagacttgccacaaaaggtgtatagtgtcagatagctgttaaatgacacagtgcaatttgaactccactaaaattcattatgactccaaagaccatgccctaaaacactaaaccataccatcttttaagagagaggtgctgtacactttgggaggccaaggcaggcagatcacctgaggccaggacttcgagaccggcctggccaacatggtgaaagcccatgtctactaaaaatacaaaatttagccgggcctggtggcaggtgcctgtaatcccagctactcaggaggctgaggcaggagaatcacttgaacccgggaggtggaggttgcagtgagccaagattgcaccattgcattccatcttgggcgatgagagtgaaactccacctcaaaaaaaaaaaaaaaaaaaaaaaagaagaagaagaagtgctgtagttgtcccaaaccaaatggatctactcatcttggaagcctacacactgacaagccaaggttttaacctatccatgacctttacaatgcctcagcacatatcattgggacccttctacttagatgtctggctccagcatgtgagcaaatgctcttgacacctctgggcaacttaaattgaatcagctgtgacacatgctccaacttctctgacctgtgtgtagctctccactaagccgaatgcatggagcatgacttcgcaaagggttatatctagcccactcaagaggagaaagctaatccctttggcttttttttttttttttttttttttttttctaatttctcatagatcttctaggacattctggaaagaccttcaggaccagagctagggagatttgcctaccattcttaacagaactgccaaagagtcagccaattttcatcctccgaactccactagaagggagaagccccaaattccaatgctactgtttcaatctaatagttccggaatacaggagataccctttagaactcagtctgcatgtctctgagcccccaccccctgcacagctctacagtcatataatgtttatgatgctcttgatctcctcaaagaattgatcataaatttttctacttcataaagtgggatttagaaaaactacttcctataatgcttcttcctctctttaacagtcatctgaattacagcagggccttccggtttggaccttgacttccctcagtggattcggggaaatgatttgacttacacgccacttctttgacaagaatcccatatctctgcttctttatcatatttagatgtattttttaaccatataaactccatgggctcgttttggggatgtggctggcagggataggagattatcacctgatatgtcacattcacagaagaagctattaatgtcacaaggaaactgtctgtgttgctttaaagagagacagatttttgtagaaaggtctttcctgcaaataacagaaatatataagaagtcccagcttttgatcaaaatgaacccagggatctctcaggtcatctcatacttttcaatcatggcctgatttctatccccatcttaaagaaagcggggatgaggttaagaatggagtcttggcttctaagggcaaggattcttttcctcaatatgatcagaaacattatccatctatcctattagcaaagaaaaaacaaagctttaccatggtctccgacaaagatgacgttgacacaccgatgcagttttagttgtttcagtccatccattaattgccccacaattttgtcgatttccctcagaggatttgtcatctaggaaaaagaagcaagttagtccccacagggttttctttctttccctttcagtctctcatagatcttctacccctagaacattttggaaagaaaacttccggcccagaggcagagctttgtctggggagatttgcctgccattcttaatgaaatctggtctaagcacgttatatttgtattcttttgacagaattaaaacctctcctcatccaatccctttaaagattctttgatataaaaatgtcaaaaatattgttaatgaaaattctttaagagagaaaatcgactttctaatatgtgacagcatcctttaaatccaagagttttgagagtaaacagaaagtccctaagtgaaatcacattagattttgaactatggcaagaagatagacgctaagtgaattcaaagctgttctgaggttaaaatcacaacgttgcactggataataaattagaatatcattaatacaatgagatccatcttgttctaagtaatttaactgttggcatctgaaagcaatagattcttaacagaagaacctattctaagaaacaagttattgcttctcactttagttcttttaaagctgattttgagtgaaacaagaatctataagagtcctaacttaaaaagaagtgaaccatgagtttgttctagaaggtttcttctttaacaaaatatgaaaactcaattcttttctgaagaccatttccaaagcctaaaaaacattacccatatctcattttcttacttcaaatggaagtttctaacagcatgaatgtcctcacatactagaggctctccatccccctttcatctttagctgtgcaatggaaagatttttaagaaacatctgatcagacaaagaatagaaagatacagggagtatatttagatgaattttatagcttagctaacaatcacataaatatacccaagatgattaagataagaacagaaaggatgtgaatatcatttttactcggacacataatattatcttccactagcatcttctcagatgaatcaagacctttcctcctgttatttcattgggaaatcaggtgtaaacttttgtttttttcttcatgacgggagtcagtatttcaagtcctatcccaaggaggaagccacagttgaaagtttcagaaagacatgtgcagaataatcggaagggactaacgggtgtggaacaaagtggtatttgcttctgagaaaatcatgctctgctccaagatctctgtctaggtaaagaaataccaaatgaacaatgtgttttgatctttggcaatgacttattttcctttactcagcaggatgactcaggtaaaatccagaacctacttcttagggatcagttcagaggatcacaaataagatactgcctcagaggtattcaaaggttttaggaaaagcaacaaccgataggctcttctgaacatactgggaagagtagacattacttgtggaaattacatacaactctatccgcccattattttctctttctttctgtcttagctatttccttctctataacctacaccttttctgatctctgaaggtacagacccctaatctaagccaacttcctattgagttctaatccacattgtctttgagaatacctccttttaccttgcagggttgttctcaagaaccagggccacaaaccatgtgactgattctgtgaataagtgcactcttaatagtcactccagcctaaatgttaatactagttttagggcaactaactcttaaaaaaaggaaaagacttctttttttcctgtcatgttgagttcaggcagtcttcacatcagtgttaacctctgaagtaccacattcttctggactcaaagccaaggtcaatgcaccagagtttttctaaaacttgctcagccgattttccaaccaaggcactgaaggcaaccttcaactcagacctgcccgccacaaagctttggaacaatagataaacttactttgtcctgacgagtttccgcagcataatgatccatcctatgtatttttcttcttcttttctttggaggagcaactggtctttcctgtctcctcttaggggcaactttcctcttaggtctcttagccggagtaaaaggtgagccataactactctcctgtactggcggatagagatgtctggactcagaagtcgtctgtccctctgagtcagatataaagcttacactttcccatctgggatcagcagagtctcagaataactaaggctccttaagtgagaaaaaattggaatgagggatggatgattagaggaactctatggagagaagcctcctaaattgatgttgatactgttgtcacagcttcttcgctgagaacaagaatccaatttaagaaaatctagtcatgtgggtttcttttggctgatatttatggatgtatgggaaggtggcattagacaagctctgtattccataactcctgcattagggagagactggtctttggttatgaaaagctctccatttataaagaactaactgaaaagtaggctaaatactagccacttggtcatttcaagaggacaatgaggttcatgtaagtgattccaattcagaatctgacagttatctttctgttcacgtcagcaactatgtcaaagcaactgtcaccttcattggcaaggatccagtgaaaaattttaaaaccaaggacggaatgaaacataaataataagtaatcctccttaatcataaacgtactcccacaaatcaggactttcagcaggagagagaactcactgacaattaaggttttcagtacagaggaactctaagttaaagtccttttaaaattaggtaaaatctaaaaagtcatcaaaaagtcatctcttttttgtcttggtatatacagaccaagaaagagtctccttatgctcttgctatcagaaacctgcttttaaggggcgttgcatgctatgggttttgttttgaaaatccagagagcagtgaagttgacacataaactgaagataaccttttgggatttccaaatgctggaggaaaaacaggcccctgatttgctgatggtgcaaaggtgaattaaagcagcaagccttgctgtctacctcactgacttctctcggagggtgggtggggggaatgtcttgagagccattcagatgcaggaaggggcgggaggaggaacaatgttagtgtatccaagaaggggaacatctgccatgcgatttcactgtttccagggcaagccatggcaaaggcacttctgtttctgtctcatcctctctctccaccaaagcaatcaaaagacacagccccaaagactttggttttgtttgtttgttttttaatgctcctagttttaggcaaatctccataagaaaagcagcaaaaggaaaagaggattttccgtttcatggtcactgaatacattctgctagcgctcaagtcggcccatcaaactctatgccatttgcaagagacctcaacattccaaagactccaaagatgagcccttccaattgcagcaggttagaggagcagaagagtagggtttagtcaaactgggttttcatccagtgattatatcgcatgtatttccttcttcaaatgttagaggtacatgaaagctaagttttcactgaccagccatactttagcctgaatttagaaattttagcctgaggttattaagaggatgggaggtagaggtgcaaatttccctgcatttcaggatactttgccatctgaaggtagagactagccagccaaagctctgcctgtaggcccggaagagcagccgaacaaggggtcacagaaaaagcatagaaggtcaaaaagaaaaagattgcgccaataatcaaaagcaagcatatttttgaacattcaccattacactctgaaaccaggagcaatacaccatttcttgaactattaactcaatgtttggtcatctcatttaatagcttttgagaatcattctgaaaaaatgtggactcaaatatttagcaaataaagcacaaatttcaactgaattcatcttattgtagcatatagcattttggtagttaaaatcatttcaatgaaatttcaaatataggttattttcttatatgtaaaagatacgttactgattttaaaataatctttcaactagtatgttataatcttttcatgtataataagtgtaaatgatgatatataggtaggcatataggatacacaggtgtataaaccaattagcctacaatagaagagaatttttgctgacttgctttggtttcatgttttaaaagcataaactattttgtttttcattcagttaaaataagattcctagaaccagatgagaaataattgaaatctgaaaatatcctttgccttatgagaagaaaatgaccaggttatcagattaccattactgaagatatactccaagatacccaattaagagtttatccagtaggcatatgaaaataccctagctgcaagaagtagtaatactgaaaaaaacataacatgaatactttcaactcttaattcaaaggtactataggaaaaatctctgtttatatatttgtgagcaaccctgggcatagaaaaattattatagcaaattaaagcatcctgtatgccgcttcatttattccctactcagtactttcaaaaaaacttatttgtttcttaattcacacaaacatatactttcatgcatttaattgtaactgaactacacatattagaaacccaaagatgtttattgattaagaacatttatcattaagccatataacttttaaggtttgagttatacctcatctgtattattaaaagccaaacttttgccataaagaaaatgttctgtataatttgaacatagttattaactgaccactttgcttatctcctggactgcaggagggttaaatggttccatggaagggagtgtgctctgggagtcaaaagttctgtagtgctatcttcaggttctccccttagcagccaagcgaaagtaccggagtcctacttttaaaaggatggctataccaatccgttttgcctaccccacaggttctttgaggggatgctattacccaagaagtcaaacttttaagtagggaacatggaactgcttaggtgttttgttttgttttgtgaacattttgataaaatgtggttccttttgttccctttaggttaatctcaaagaaagtcaatctaaaaataaaacagccattcttgctttggtgttctttactggcatcatgtatgcagatgtttatctcattttatcatttgtgtttcacaatcatacaagacgggttaaacttcaaagggacagaaaaagagcatctgacttatataacttcagtgatttaagactaagagtggttttacgtagctattagttactagtgcttaaataaatcacctctgaattgatgtcaaagcattcagaaacacttatgactccttggtcacatgctgcaagtattgtcaaaatacttaagtattgtcaaaaaacttaagtattgtcaaaaatacttaaaccaagtatgtttaaccaagtatgtttaaaccaagatatgtttacctgtatttctaattcatctgaaaacaatgaacttaattatagtcagcagtgtcctatgggttactaggctacttaaatatttaaaaatatttaaaaggttagatttgcaaactccatcatattttttactatctatgctgaaaatgtgggaacatttctaaccattcctttcccaccttctgaatttgaaattatactggatactacctcacagattgtcttccacaatgatggctgagtgtttgataaaaatatgtcaccctcagctgggtgtggtggctcacgcctgcaatcccagcactttgggaggccaaggctggtggatcacctgaggtcaggagttagagaccagcctggcacaacatggcggaagcctgtccctactaaaaatacaaaaattagccgagcatggtggtgcacgcctgtaatcccagctactcgggaggctgagacaggagaatcacttgaacctgggaggtggaggttgcagtgagccaagatcacaccactgcactccagcctaggtgacggagcaagactctgtctcaaaaaaaaaaaaaaaaaaaaagtcagcctgctctgctaagcagattcattcagtggtatatttttctcaagaatttatgttactttgggggggtgatgactatgttcatatcttgaatgtggtgacaatttcacagtatatatacctatgccaaaatgtattaaattcaaaagggtccattactataacttatgccaagttgattgtattatatctgccaaggttattggagctgcttagctgatctaccctctctaaactgcctaatcatttcaagggtgctgaaattcatttacaatgttttgcattgcaggtttcatctcaagatttttttccatgcctagcccattgaaggcaaatgccaactcttccgaattattcaccctccaactgacgcccacaaggctagaatacaccccatctcctgttaacatcaagtttaggatatattattatttaaatatcaaatcaatctgaaatgaagctcctgtaacagaaacaggtcgttttaagattttttaaaaaatttttagtcttgtagttatttgactttgcataaaccttgtagatacaaacatccatccagactttatacaattcctgaaataaagtcagtagatcaggtagcccagggccacagattcttctcaggcagatgctaaaccactaacctcagggccgaaagggccatatttgtgtccagagaaatcaggttgctcagaatagaaggcatagaccgaaggcctataagaaaattggaaggttcagaatctctcctaaaccacatgtaacaaaaaatatcacatatttttaaaaaacgcatttaaaaaaaaatgttctcaagtttaatttatcctttaactactattcatgttagcatgaaaaacttttttttttttctgttgcttctgtgaccaccaccccatctgtagtaactgtctggaaccaccttcaggaatcaaaagtcacaaaggaaaacttgaacctgtactcggatccttgaccctcaagataacagagcctggcggtaattcacatgggccgtgcaatctgcagcctgaaacaacaactaactgcattacagagaagcgtctctctttatacttctgcaatccttgggatgctgctggttcatttatcaaagccagaaactcccttcggctctgctgtagtggacagaattaatagctgcagtaatccaagtaattaaatggtcccaataaccaaagtctattgtatccttcttagggaagtaacacttaaggctaagaaccacaaaacttttaattccaaacattggctgtgcttctattccacagtctagtgtttcacgcaattctaaactaagatagaaatgtactgaagaaagaagaaagagagaaataaatacctctcatgatctggcagggtgagccactgcaatatggttaatattctccgctcgtgagggatgacactggagggtaaaagcaagcaaagcatgttgttaggtttcatttccgcaaactcaagcctgaggagtgctcgctcttgcacccaggccaaatgctctctatttaccaccatctgttttcacttcatttgtagtaaaaggccctctttcgaattagcgtttaaactactatttccatttgcaacatattacgttgctcaacctcttccacagaagactacactggaaactctgattcacagtcagaatgaggaacctgtcttgctaatcagaaactccactacaagcagaaaggaccctggtttcagaatcattgtcatttattctgtcgagcctttagctgtggccataaagggatcagtacttacatccccaatccgcctcttgctggcggtgtgacctctcttgaccactcggtctcagtttactcatcggtaagataaagctaacagcaaagaacactgtacagcttggttgtaaggatgaaatgagacaagacaaggaaagggcatgtccagtgcgtaagacacagtaagttctttaaaaacatatttttattaatgatcataatgcgttatcattctgcctctaaataatggtatgactttagaaacactacctaacctgaaactttaagttcctcctctataaaataatgggttagggaaggtattcttgccattttcttccagccctgtaaaaatctaccaagaataggccaggtgcagtggctcatgcctataatcccagcattttgggaagccgaggcaggcagatcacctgaggtcaggagttcgagaccagcctgaccagcatggcaaaaccccgtcactactaaaaatacaaaattagccaggcatggtggcacatgcctgtaatcccagctacttgggaggctgaggcaagagaatcgcttgaatccaggaggcagaggttgcagtgagccaagattacagcattacactacagcctgggcaacaagagtgaaactctgtctcaaaaaaaaaaaaaaaaaagaataggcacatataattaagagactgacaaaaagggtataatcttcatccacaataacttttgtgtttaagtctctttcctctgttgaaatataattaccctaagtctggcactagctttaagggctctaaggcctcacagctaacatgacagtattgcatccccggctgagttacattcagatgctcacaagctgagtgatatctttagtcaggggaaattcacccactctttcccaacagggagcacaaaatgcattttcactccccgatccaagaccaggcattagaggcatgttcatgatgaattcaaactaaagcacaagtttaaatgtggtcaggaaaaattattgtggaacattggtgagccatttaaacttttactctcagtggacatgagcagtgagagagctgggagaaggataaatcctcaagccggggctctcatcaagtggtttctcttcctcccccatcaccatccagctcacagggatttgtcattccccaggcaccctctctttctggaactatcacacaagaccagaaaatcatgtgtgccataaaatgagtccaaatttaaacatattccaatgctattggataaatgcgaccctgatcactatatcctataattgaattagaaataggcagagcaaagccaggttaatcacttaaggaatttaattcttcagctttagaaatcctttgtatctgagcaaaataattgcatactttgaattctttcctgtttaaaaaaaaaaagtgaatgccagagccttttcattatactttatttcactacctgcctaaaagctgctttattttacgtaattggtgttaagccacagaaacgggccctaatgaacccactttcaatactaatggaaaaatacaaactaacagaatctgtgtcaagctcagaatgctcacccctgaatgccctcgttggatggggtacttgaacaatggtagacggggaattaaaagtgccagctatgaggccagagtgcttgggtttgtatcctgactccaacaaatgctggtgataagacttggcaagttatctaaacttttgatgcctctggaaaacgaggacaatataatagtacctatctcataaagttgtagtaaaggtgaaaagagaatacatttagaatagtgaaaagcatttagaatagtgctgggcacatagaaagggtttagaaaaatgttagcttttattgttatatactaaatgtataggtctgcagagatgatatattcattcacaaaatatttgttaagggcatattgggtttaaggcatttgtgtaaacgtaaataaagatattcctaccaaaaagactattatggaggggtcgtcattttcttgggggaaagataagcaagtgataattcttttctgggcaggggctgattgtgtttgtgttgagaataagatgaggacgctggaggtctgagtagccatcctacctctgaccttaggtgcaacatttaacctctctaggccttagtgttctaacctctcaatctctctcttttttttttttttttttttggttgttgttgttgagatggagtcttgctctgtcgcctaggctggagtgcagtgacacaatctcggctcactgcaacctccacctccccggttcaagctattctcctgcctcagcctcccaagtagctgggattaaaggtgcctgccaccacgcctggctaatttttgtatttttagtagagacggggtttcaccatgttggccaggctggttttgaactcctgacctcaagtgatccacccgcttcagcctcccaaagtgctgggattacaggcatgagccaccacacccagcctctaatctcttaaatgaggagttgggcaaggttgtctctgtttcctaggagttctagattatctttatgaaataacctcagagaccaaaaggacatggcccttagccattagcatttcaaatattcaaatacaatgcgcagacagcacaaataaatctgaccaagaaagagcaaaaaaagaaatggggtacatgttgctgtcttcaccaccactgattgatgcagaatttgtcatgagaccaagtatattagaaatggtcaaaaaaaaaaaaaaaagactaagttaagtatttactagtaaaggagagcaaattatcttaagtcatatatagcccttgtctagtcaatgttgaaagagagaatgtgaataagaaaacaaataccatttattagttgttctctgtgtaccaaataccctaataagcattttatgttgttttattttattttattttttattttttgagatggagtcttgctctgtctcccaggctagagtgcagtggcatggtctcggctcactgcaagctccgcctcctgggttcacaccattctcctgcctcagcctcctgagtagctgggattacaggcgcccaccaccacgcctggctaattttttgtatttttagtagagagggggtttcaccgtgttagccaggatgttctccatctcctgaccttgtgatccacccaccttggcctcccaaagtgctgggattacaggcttgagccactgcacccggcctattttattttatttttgagacagggtctcactctgttgcccaggctggggtgcagtggtgccatctcagctcactgcagcctcaaactcctcgggcttggtgatcctcccacctcagtctcccaagtagctgggactataggcacgtgccaccatgcctggctaattttcgtatattttggagagatggggttttgccatgttgcccagcttggtctcaaactcctgtgctcaagcgatccacctgccttccaaagtgctgagactacaggcatgagcccccaggcccggccataagcattttaaatatgttagctcattgcatctttgcaacatcccatgatgaagataccatatatgtgtgtgtgtgtgtgtgtgtgtgtgtgtgtgtgtatttttttttttgagacagagtttcactcttgttgcccaggttggagtgcaatggcatgatctcagctcaccgaaacctctgcctcccaggttcaagccattctcctgcctcagcctcccaggtagctgggattacagacatgtgtccccatgcccagctaattttgtatttttttttttttaggagagacgagggttctccatgttgaataggctggtctcgaactcctgacctcaggtgatctgcccacctcagcccccaaagtgctgggattacaggcgtgagccaccatacccagccgaagatactgtaatttttatttgaagatgaggacatggatttgttgagagattaaatcactagtccaaggtcaccaatctaataagcagccaagctgggatgagaatcaacgtgaacaatcatacataatgggaattactgtctttgaacatgaattggcacaaaagaatggagcatcagccgaagattatttcagaatgaaatactatcatttaaaaggcaagaataattctaggttgcagtacggaaccatgttaaaaagatggccttcaaagtctaagtctatggtttgaatcaggttctaaatttttttaagttttcagaatatacactgtgtagatttccttgacgtatatattctcttaactaactgaaagtgtgatcctatttttttaaagttgtaaaatacttcaaaaaaaaggggaaaaaatgaatccaagtcactttcaggatacagagttaaaataatagtctgagaagcaaatgaaagctacagacatctttggagcatacaaaagccaccttcttataagtgatttcaaatgggtggagaaaattgccattcaaaaccagaacactgggccttttcaatgaggctttgcagcagtttcaggggggcaaaggtggggactcagtattaattatgttgttggctcctctccattctgccaggcaaatatgttacagaacagaagaaaatacttctatgagcgtctatgacagtcaagagttaaagaaatgtcacacataggataacactggtaaatcaacatgctgtttatattaagcagtatcatttccaacctacctacacttacttctcagctcagaaacctctttaaaaaaaaaaaaaagaaagaaagaaatctcttaaagggacagtgtgtgctagattcaaatcaccaaacccaatttcaatttagcccttcaaatctgaaaaagctacttttatttctgattttagagagtatagacagtaccgttctggattaatttgagcctgcagtagctctcagcacactgctattatagaatagtcagatttttgttaggcatacaggcaaatacagaaacagctttaggtggtttaaaaaaaaaaaaaagatggaaagaacatctcagtgggaacaaaatccccgtgaaagttgaaacagattccttttcttactaaggaaccttaaaaatcatcaacatgttgatacttttattaggtaagattcatcttaaggcttatgaacattaactgcttatccccccatcacttctttagggatgggaaggagccccactttcttattagaaaaatcctggagttcagtgggaaaatgaggtgaaaatagaggcttccccttggtctcctgtctggaactttcaatctctagacgactccttcggctccccagaggcctgagaccatctagatatttttaagttgtgaaccaaaataaatataatatgttgtcatatatttatagaaaatgataacgacagccactgccataaatagtctaagagaaatatacatgtcctagatggcaagttaccaaaaacctacaaacaggaatagaaaaatctaaaggacatccggaaggaggagagaccatcttacattctgttgagaggatggggctgggcacggtggctcatgcctgtaatcccagcactttgggagacagaggcgggaggatcacaaggtcaggagtttgagaccagcctcgcaaacgtggtgaaaccctgtctctactaaagatacaaaaaattagccgggagtggtagcaggtgcctgtaattccagccacttgggaggctgaggcaggagaatcacttgaacccgggaggcagaggttgcagtgagccaagattgcgccactgcactctagcctgggtgacagggcaagactccatctcaaaaaaaaaaaaaatagagagagacaggatggaaaaaaggagagctggaggacaaaaagaaggtaggatgaggcacagagggaggatctcaggaaaaaaacacctggaaggttattttgatttagtaaatattcaaaagttctatattttcacatttaactgaaacaaaataaaacttaaattgatgttttagaaattgaatcatagctgtcattttataaacattgacaaaataaaggtaacttacacagaccaaaagaatgttccagctttcaccccttgcttggtggctgtaatccatagctaatgaggaaaatataagcggcttaaaatgtgttctgtgtttttgtcaaagaagaaaaagtttttaaaatacattagatcagatatcttatactctactcacaccccaacataaattttccattatttgcaaccatttattttcacatctggaagtcagaatcattatttccacaaatgttattcaatatattctctgcaaaagctctcaaaagctcctgctatgattctagtgacatattttttaaaatcttattttatctcaaaagcctctctcttctgtacctgtcttttctgatcattgttttgaacaattaacttatgcagcataattctgctcatcaaaggacccaagagtgggccatatgtttcctttactattgaaagcctcaaggaggagtgccccaatttggcatccagatgtcagaattttggaatccagattgtcttgttttagtttaaactagatgaatgagaagggggaaaaaggctaatttttaattttgatttttcctaaatcttttacctagccttttagtaaatgttattttagaggaaagttcctagaataagttaagtgaaccaagcatttcatcaaggtttttaaaatattctttacaccgtgtactattggggaggcataagatataggagtttagaacctgggctctgcaatcagacagtttggattttaagccttgtttctgtcacttaccagccatgtagtcctttggcaagttacttaatatctttgtgtttctgtttcctttacaatgtaaataatcttatctagcatataggattattctaagctttaatgagttaatacatttaaagtccttaaaccagtgtcttaacatctggcaaacactcgataaatttacatatttattgttatgcaataatggaaataaataatccaattattctagtaatattaaaaacagcctaagatggcaagtgtcccactgaacagaagtctatgagaagaaaccccctcacttaaagaaagagaatggaagcaaatacgagagagaattgtggtttgcctaagaccaaaacaaaaatgatctgggaattgtagccagccccttttctggtttcattgtcaccagcctttgagagtatccttaaagagtgacaacttattttttgaggaaatgggtaactgggaggtggagaacatccagaagcttaaccattgtttcaaaatcacctgggatacctgccctgggaaagctcgaaaagggttccagcccccttggagcctctagaaatcctcagccccaaactaacagctactgtagctggcaaatgagggatggggcaggagaacgtacagagcactcttcagtctgtgggttctgagctgctggtgaatttcatcagcctgggagaggtaggggcctcatcctgttcacatggctctgagggaccagaccttcttggccagacttttggttccctgggatgtttggagacataagaatctcagattgttctgagagtccttcactccatttagtccaaagctctttctattttaaagacaaattctggcatcctccaggaaccccagcccaactagggttcagaatgtgtcctggactttcattcattcttgttccagcacctccaccagcaagaagatgagctcaaatgaagtgctggacacactataaaaccatgccagttcccaaagaggccagttccttatattaagggatctattttcatacttattttaattgcttatacacaatcttagcacattccaatatccaaacaacttcctagatgtactgccttgctatttccaagaagattgtactaggcaatacttggcatctatgaaatttaagattaatatggagtttcctaaaggaaaacacacttttaatacaaatttctcaaataatgacctgcactttcaaaaagtatacggtagaatacatgctgatgttggcatcattagggcaacaggaagttctgagagttaatttaactcagtaatccttagggaaaaaagatcactggaagaggtctttacagtgtcaaaaggaaggagcacacagagtgaaaatgacagggtatgttaaaattattatgatggcaaaattaagatcatttgttctttatatttttctgtactttccaacaattttacagtgacaatcaacttacttgtaatcagaaaaaaaaaactaaccaattttaaaaagcagtgtcttagaagcatacagtgtaaactatggaggcaatttaaaggtaaaatttgtatttcttctaaaaacaaaatcaaaaagcagaaaaattctgcctgtttcttggtaaaagtcaggttgaccacattttcaaaaagaaaattgagagcatgatcagaaaagtataaaaactgaacaaaaaagataaaatacttaaaatgaaaagcacattttcccaagggggggaaaaaggcactaaaatattggtccagaagaagaaaagtgaatacaagccgataaggttataaaagagagagagagagagagagagagagaagcttcccggttccttgttaattcagagatataagtgtcaaagtttctctgaatttgaatgcaatataaatttcttcagagggtagtttaaaaaaaaaaatcaggccaggtgtggtggctcacgcctataatcccagcactttgggaggccgaagagggtggatcgcctgaggtcaggagttcgagaccagcctggccaacatggtgaaacccatctctactaaagatacaaaaaaccagccaggagtcgtgataggcacctgtaatcccagctactcaggaggctgaggcaggagaatcgcttaaacccaggaggtacaggttgtagtgagctgagattgcaccactgccctccagcctggatgacagagtgagattctgtctttaaaaaaaaaaaaaaaaatacaactaaaaaaataagcttaagaaaacactgggtttgggctttctccctctaatcccaaaactccctgcattgctttcctttatctggaggcccagctttcaacatttgtgtcctagatgctgctttgtgaaaaggggacaaatgggaatgacattgtatcttgtgatgtgctatttattagaaatcaaaaaggcttcctccacaggaaccaagtaggttaaatatgaaattcaacactttctcaaattcagcatgtagctttgggagaaaaggagaagtttggaaaaagaaaaatattagccaaaaacattttttcaaaaaacataaactactagtgcagtctttctagcagttcctcgaagggaaatcattcctttgcactcgaaagcattgagctaggataaacagaattctaggagaccaggggatcggtggagcacttgcttcagcagatcaatcgctgagaatcagaacaaattaagggtgtgggggttgggggaggcagcagaagagactggggcccaatgcagctggtttccacgtgattagggccagaaggaggtgagtgaggaagctgttggcatgtggccggagctgccgaggctgagatggagtgctgtccttaaggccacctaccctaggggaagcacaggccaaatatgcccccgaaggaaacaaagaacagttccatccgaaacacaatagcggagccaggctctagattgggtcttcgaaacagaaatacaccaagtccctacctgcatgggacccgcagtgtaaagcagacctgtgaataaccaacttcaaaaggaggtggtcaggccgggcgccgtggctcacacctgtaatcccagcactttgggaggccaaggcagacagatcacttgaggtcaggagttcaagaccagactggttgacatagtgaaacgccactctactaaaaatacaaaaaaattttatctgggcatggtggcacacgcctgtaatcccagctacccaggaggtagaggtatgagaatcacttgaacccgggaggcggaggttgctgtgagccgagactgtgccactgccctccagcctgggcgacagagcaaaactctgtctcaaaaaaaataaaaataaaaagagatttccaaatttatgatagtaaaaatataaaagcccaaaggacagtcactttgcttagccagagctggaaatgctgggggaaggaaggcctcctcgggacagacacttcagctgaaatttggaagaaaaataagaggctggtaagcaaaggcaccaggttagcagagctcgccctaactaggtacatttggatacagtacaaagagaaaaaactgcaggtctgcggtagtatatggaaaagaaacaacagaataaagaataggttaaatgttcctgaaaagaaatattgtctctttatcaggacaataaaacagataaaaagaggttagcaatgacttgtactttccatcaagtcaaccccttttggcctggaaagtcacccctattctgtgtcattcttcttctcctgctgtctctgtcttaaacacacatttcttgcattttttcactgcagtcattcactaaaatggcttctgttccaactcattgtaccaccaatactggcagagagcaattctaggtcaagcaacttaagtgataagaatgcatctgctggacagttgcagttgggatcacgcctgtaataccaagactttgagaggctgaggcaggcaccttgcttgagctcagaagttggagacaatcctgggcaacaaggcgaaatgttgtctctacaaaagatacaaaaattagccaggcatggtagtgtgtgcctatagtcccacctgctcaggaggctgaggtgggagtgttgcttgagcccgagaggctgagactgcagtgagccaaaatcatgccactgcactccagcctgggcgactatactaagatgttgtctcattaaatataataataaatttttaaaaaataataatctgcttctcttagaaacaccttactccagaaatgctgacttcaggagacttggatcatgatggggtattaaacttgtttctcaaatctccacatttagtcaactcctaggaatcccattcattcctcccattgctgagaatccagatttaaacagaacagggaacaaccccatggaagtatctttgtattagaaattgcaggaccgtagcagagagaatttccaaagaaaccaacccacttaaggaactccattaaactacgtatgagaaatgcagggtcctacagcaaacgactgcttctagcaatgcatgttgagtattaacaaattaaaagcagactagactttaattgactatatcaaggctaaaaaacaaagattaaattaaattataaaagactaaattaaattattttcggaagacgcctatttagattcaaattttcaaatggccattgtacaattgcctcatcccatctactagagtttatgctaggacaagaagtggcttttattcaccatgtaatctgacccctatgccatttggctaaatgtcttgcatggtttagtccctcagtaaaaataaattgagtttaatttaattatcaatctaagatttgtataaatattttctcttataaatgtataaaaaattataagacttttataaatattttttcactggtgattttaaaacgaagcctctgagaggatggtataaatgcttgtagaatattcattaattttttcttatagtacttttagttgcttatactcttatactttgactaaagtttctttttaattactttttatttataactgacatataataattgtgcatatttatgggatacagtgtgatgtttcaatgcatgtgtacattgtataatgatcaaatcagggtaattaccatatccataactttaaacatttatcatttctttttggtgacaacatttaaaattttccatcttaaatacactacattgttatttgctatagtcaccctactgtataatagaacaccctactgtataatagaatagaacaatactttgtctatatgtttttccaatatgccaaatttcaataaaatgtgtttttaaattgtagttactatgctcctgggaaatcttttttttttttttttttttttgagatggagtctcgcactgtcacccgggctggagtgcaatggtgtgatctcaactcactgcaacctccacctccagcttcaagcaattttcctgcctcagcctcccgagtagctaggattacaggtgcctgccaccacacctggctaattttttgtatctttagtagagatggagtttcactatgttggccaggctggtctcaaactcctgacctcatgatccacccacctcagcctcccaaagtgctgagccatcgcacatgagccaccacgcccggcccctcctaggaattcttatggtggccatcttgcccaagatgacagaaacactagtcagtttcaccacaaatcttggtcagcatgaggagagtactaaacttggtcagatgcgtcaactttgggagttagtgaggaaacaggtaaacagagctgaaacagagacttcacttcattgggcaggttaacagcatttcctctgctctgcttttgcagaagttaatgaatatgtggcctcatcttcttctgagtcatcctaacccaaagcaaaccttatgtcaacacttggtgtaaggtgatccaatttgataaaattactatttatctctaatcctttaaggttcttcaggtaagtttgcttccataatcaaattaatataaaagacccactagtgaaagcttaatggagctctaatttcaatcattttgtgtactcataaaatattcccctatcataaactttgaataatccaccctgtcaacaaatttcactatgatcacaccctaggccattatggacttctgggagtccagcctgaataaagacagcagaatcagagcatctattataaagaaacttatctgcagatgtacaagaagtctttcaatgtttatttttttaataaaaagctcatatttatccttgcatactgatttacctattatgcaatataaatattttgatcacaaatgaccttttcttaaagtgagataccttaagaaaaaatttctatttatagtccttattttgtccataaattgcagcaaaagatttccaggtacaagatcattgaggcatggtggatacatggatgtgtgcagacactgcccaccagtcatgccacggttgagtgcacaaagttctcccagccctcttctctaaccagtgctgcaggaagccactgtctccaatcagaattggcatgagatggaaccacttaccatcttacttctacatgtttctgattgcctgtgtgccctgggttatgttcctaggtgattctgatacttctggccagaagcttgtacacttcagcccagctctgcacattcaacaactgtggctttatgctgctttgctcatgtctgaccaaagcaagttgcgtaaccatacacacggtcacaggaaaaacattaggtagaaagccacctacaaccctttttattttctgcccagtcatttgatctgaagtaaacagggtgatttcttttcaaagtattaatttgctatttcagtatcaaggtaggattctgctttttgtatttaacttcatgatttttaaaaaatagattaaataaaaaaattcatgaatttactgtggatttcagtgagttccctttttttccagcaagtttccctgtttctgttattatagcatcagggctagcatattggggaagtcacagtcatacacttctcttttttattatacgcctaaatctgggaaatcaatgagatctgactatttctttgtcaaaatggttctgaaattcacctcatcaccattgtcaccaccataatcctagggaagacattcatatcatctcacttttataatcatagcctcacaaagatgcatgcatatatacacacagagacacatacacatatgtatacatacatgtatattctatgtgcacatatgtatgtacacatacataaatatataatatatacatatatcagatatataatgcatatatacacatatttcagatatatatataatgcatatatacacatatttcatgtttgtatgtatattaaaagtatcaaaagacagaaacattgccaagtatgaggaaattatacgcattttttccacatctaacaaatttggggatgaaatgtctcaatacatgaacacacaaacacatagacacacaataaatgcaaaacttaccggttgacctccccaccatctatgattaaatttctctcgccctcgcagatgaaaagtggcatcaaatacaggatcatacattgaattgccaacaattccatgtgattctggatatagcccctttttgtaaaagcaaatttattgttaaaataacaatacaataatccacatacattagttctagtatgaattttcttagcatagaaggttttatagcaatacttaatttccaaaattatataagacatgtataaccttcactgtgtatctgtttgagcaaacatgaataatatctatgggacaaattataagccatctgagaaacttaatatgattataagaaatttaacattggggtttttttctgctgtaatttaagaagatgacaataattttcattacaataaattaacctttagtttggaatgtatacatgtgcctccaaagaagcttctatttctaaatacacttttctttctttctaaattctattgctccccgaatcaataaaaatatataaataaattatgttttaaagaaggaagagtggtagaatttgaagtacctgaaaattaaaatatagccctgaagtcaacatttttatttgcaaattcagaaaataaacaatagaccctctggtatttgagagaagtttaatgtatgtgttcaaacagaactgcacctgaaaaaagttttcagctttaaagttggaatgaagttccatcacccacaaagttgtaaaaggcatttgctgtgaacaaatgacccagttaagatggaaaacagaaagattttctttgaacactaaggaacacgttttaaaagtaaagtctctcctttaaagtcattccaggatgaaatcagccctttgaatgtgtatcattcgaaaaaatacttacagtggccaaagtgtataagttaggaaaggttttagttgggtacaccggcctcatgtagggagagtgtgtgccacaagaccctggaaagagaattgcaaatattagaacaagagaaccaacaggaattgcttatagaaaatccattttataaacactcagacatgtgttaccttcacttctgtatttcaaataataaaacacatttaaaactacgtgcccatagatctcaaagcccacagcccactggttagtgtggagatcctagattacagataagaacacagagtatggaaattacttacttagtttttcaatattaggcatgactttgctgcctttcttcatgtatgatgcacggaagccatccacggagaagatgattaatggagggcgaacaaaccttaaacagtaacacattaagcttttagaaacattattaccagagttgccattacgcctagtgattctcaataatgggagcaataatttccaagaaaaaatttcaccgggcgtgatggcttacgcttataatcccagcactttgggagtccgaggcgggctgatcacctgaggtcaggagttcgagaccagcctggcaacatggtgaaacccccatctctactacaaatacaaaaatcagctgcacgtggtggcgggcacctgtaatcccagctacttggaatgctgaggcaggagaatcacttgaacaggggagacagatgttgcagtgagctgagatcgcaccattgcactccagcctgggcgacaagagtgaaactccatctcaaaaaaaatataataaaataaaataaccgaacatattcatttaaccatttaaccacaagccagtcatggttaaatcaagactgcccaacaaaaatactctgtcagtcattcattatctgaattcttgtgtatgagatctgttaaggtacagattaagaagtcatgaaacatttctgttttgtaacaaataacacagtgacctgttattattcattggtagctttttttgagatgagctatcaaggctgccctttctgccttgttcttcatgcctgcgaagatcatttttgttccggggatgtgcttcttgggattctccaaatactccatgagtgtatcctctccccaggagatgcttttgttcttatgggcctctgtataagagaatccaatggcctgatctgtcttccccacaaagagaccatggagatttgacccagccacctgtttgcctcccttttcaacagtgtggaactgggcacacttctgaacaaaaattctcttgcctttttcaacatcacccatatttaattctctctttggttgctggtgctataaaggttcccattcagaagccagatgtcccactgccttggatgccttttttttttttagagggggtctctttcatccaggctggagtccagtggcacaatctgggctcaatgcaacctctgcctcctgggttcaagcgattctcatgcctctgcctcccaagtagctgggattacaagcgctggctaattttttttgtattttttttttagtagaggcggggtgtcaccatgttggccaggctggtctcaaactcctgacctcaaatgatatgcccgcctcagcctcccaagtgctgggattacaggtgtgtaatcaataagtaataattacttattggataacacagttttaaaggttctcaggacttcctctttcattccccactccccgcaaagtaggcaaaacaagaactccaggaaaaacaatactgaaaaaaagtcttagccagaatattcagatgcactttgtaaaatcctcagctgaggtggaatataggggatgttcagaccccaatatgtgcagaggtgattggagaaaactggggggaagaaaactatcaccatttcaagacctaccttcaacctttcgactcatgaattactcctaagtactcataagtttgcctgtataagagaatttcagttccacattgtttctaaatacttctcttttcatttcctgtgagagtttatcagctaatacataaaacttcaaaatagtcataaaatacacttaccctgcagggcattctgcggcctttatttcctcacagtcatcatcaacccaatgcgactctcctataaggaaaaatgggtaaatgtattgttgaatctaattacaaatgccatgccttgaagctcacaattccaggatctgtgtcctgtttgatactttctttatgggatataacaaaaaaaaaaaaaaattctgaaaaaaaaatctagtgtctggtttggcttataaagtacacccatacatgatgggaaagctaagatttaataaccacaagtggtgaggtgtttatttgagccttccgagtctaaatggtttgtagattaaaaaaaccagtggcgtcagtgaacaaaatttcatgtttgtatccctccagaaataaactgtttggtcattagatggaacattcttttctccaccactggagatctcaaagccatagaaagcatggcaaaacttccctttagatgctaaaaaaaaaaaaaaaagtcttagaatctacagagataataagtggaagattacaatagaaagattatttgccaataaatctccatacagcccttgaatttagaaagaaaaaaatgctaaatttcactttttatcttccaccaagatctaagagcataatgtcgagaatagagaacagaaaaggcctcagataaaaacataagctttgctttgaagaaaatacaagttatcaaaaagaatttgccttaaattattttaagacaaacaaaagttacatatcctgaacagaagtaaaatttgtaaccaacacattggagaaattgctcccatgtaaagagaactggaaatcttctctggtcaataagactctaactactggacaatggggtaactattatgctccttaaaataaagaagatttgctacacatatagtaacccagagcacacacgtgggcctcacaaaagtactgaaactagaattttaaaccagtaaaagccaatgcttaatgattcaatgatcaatgattccaagggcttctttttttaaaaaaaattttatttctaacagcctttgtggcttcctggtacacttactgcacaggcaaattaaaaaggaaagggaaataaattctcaaccaattttatgcttcaaaataaaagcataattattgggtaggggaaattaacaatacaataattgtttgggtatggggaaattcttcaaatatattaatataacaccctcttgccacaactaaacaccttacatattgcagaagtaacttgatttttttcctgaaatcttttaatgaacttcttcttaaatgttccacatcagagataatgaaaaggacttgattttgaaatttaaaaagtgacttacaaacaatagataaagattcttggatcttcccatcaacttctataagtgggttgcacggcaacttaaacccattaaagagaataactgcatcttttatattttctgtagtccattaactattgttaattgttggaataaaagcatcatattctacaatcaaccagacaaagccaacactcatgcatatatggctttggggtataacaggaaatgctggccccctcatcccctttaccagcaagtacccccatccctgggcagttgccaatgccttggtgaacagtgtacatccaatagataaaaaagccctggttccttgcctcaagagtagtgacctggatttacttttcagagcaagcaatagagggaggcgaggctaactgagagcatgtcctcacttgtctctccacactcctccttccctatcctgcttccctttcctccgacatggttttcctgcagtatatccgtttcctcaataaactgcatgtaccgaattcctgtctcaggatctgcttctagaaaacttgacctaaaaccaagataggaaatttagaaatctcttcattattatgtttctgtctaattaagaaattctggtttcttcccttgttacttcagatcagtgaaatacagagtagcaaaactaatgaagaagcatgagaaattaaaaaggacaattcattccttcctcccaaactcatatccagtgtggtctattcctagcatccaggatctcctggagcacctccagtttttattcttttaaagctcaggccaatccaaagaaacacgtacctttgcaaaccacttggtaattggtacagcagtctcccctggccaagcagtcctctgagcagtgacaggcattttcttcatttctgacttctccacatctgtccttagtacactcccagccacgggctaaaatcatcccaataaaacattttcactgctgcacactaaccaaatgaaagaagccacaattgcttacaggatttccaatgaagaaagctaaaatctcacatcatttactctgcttgtgaaatttgagttggcttgaggcccagaggacatttggagaatttacagataagatgaatttctaagttttcaaatcagagaacaacatcaaaatgcaattgggttcctttggaaaaatggggccctgaaaggcaagcaagtatccctacgattctcgaattgtcctaaaggacccaacaaatttatgacatcaaaggtttatgatagggctatctactgttgtagggacagcctctatagcttggctcttttaatttctgaagtgggtgtgcttagctttatttttattttatttatttatttatttttgacagagtcttgctctcttgcccactctggagtgctgtggcgcaatctcggctcactgtaacctccgcctccctggttcaagcgattatcccgcctcagcctcctgagtagctgggattacaaacatatgccatcacgtctggctaatttttgtatttttagtagagacggggtttcaccatggtggccaggctggtctcaaactcctgacctcaggtgatcctcccaccttggcctcccaatgtgctgggattacaggcatgagccacagcacctagcctaaagtagctgtgcttagcgttaatcagtgtgattcaaacacaaataacaggacaactacatggtttctatctgcacctggaggttaaagtcctaaataggatgtgaagagtataaagggggcattacaatgtttgctcaagattctaaccactgacccattgtggtcctacctacaatgacaggtcagagttcctactttcaagccaagtaaatgggttacagatttccctctgaacatacctgattgacagctcactgcttaattcttacatttcagaaaaacaacctttccattttaaaaggagtgctgtgttttttgactttttcatctgctagagtgtaagcgccatggcaggaaaagtgacacctctctcttcgctcttctatttccagtggcagactgtaagcctgggagactgcgcctggcacatgctaggtgttcaatcaatatgtattaaattgaattggaaatgaccatggagataaaatataactctttaaattcagaactactctattgagaactttcatagttaactcatttactcattgactcttataccatgttttccgtgttctcggtgccaggatgtcataaagaacaggagagactaggtctgtcttcatggagcttacattccaattggaaaagacagatcataggcaagtaaatcaataagcaagatcatttcagcttatgccaaatgttgtgaaggaagtaacaggtggcattgatagagaaagatagggtgaaataggtgctactccaggaagtagaatggtcaagaaaggtgtcactgagctaaaatacatatgaacacttcaggtctttatctcttaaaatatgtgataagtggaaagaaatgatttttaaagcaatcctgcctcttagtaatattctaccaagagaaacaactattgttaggtgaatacattaataaagagatattacgggccaggctcagtggctcatgtctgtaatcccagcactttgggaggccgaggcaggtggatcgtgaggtcaggagttcgagaccagcctggccaacatggtgaaaccccgtctctactaaagatacaaaaaattagccgggcatggtggtgcatgcctgtaatcccagctactcaggaggctgaggcaggagaatcgcttgaacccaggaggcagaggttgcagtgagccaagatcatgccattgcactccagcatgggtgacaggaggagactccatctaaaaagattaaaaaagagagagagatattagttgtttggcataactgctacccctgccccttttggtaaatcattagccagaaaaccatgcaattactatttaatttttattcttttagaattacctttgcatcctgattctgctgtctgatattttttgttgttttgttttgtttttttgagacagagtctcactctgtcgcctgggctagagtgcagtggcataatctcagctcactgcaacctctacctttcaggttcaagtgattctcctgactcagcttcccaagaaactgggattacaggtgcctccccccatgcctgggtaatttttgtatttttagtagagatgggatttcatcatgctggccaggctggtctcgaactcctgacttcaagtgatctgcctccctcagcctcccaaagtgctgagattacaggcatgagccactatgcccagccattctaattttttaatatcccgtttccattcctatctcttctcgaggagattaagtgcttagaattgcttttcccatgacctgctcttcccaatgatgagcaatcttctaaggttgctttgactctagatattgtggggttttttcaattcaaggtgattctatccaccaataaacttttattccactcctaattccataagaaaatcacatctacattacttacaaaagaatatcattattaataagctatgtttattgaggaactattgtctttatgtacaaatgaaatataaaataaatccagagtttaaagtgaactatacacaaaggacaagtcagtcatctgtgtaattttcaaagcaaacatgggaataaacataaaaaatatttaaccttattggaaaataaggaggaggtcacctaccagattattttaaaaatatttttaaaaataagagtattcaatgctgaaaaggaagtgatgaaaggtccttgtgtcctttagtagaaacataaactttcagaagtataatttagtaatgtatatttaaatttaaaaaaaatgcacatatactttgaccccaaaatcccacttccaaaaatttatcttaaggagaataggcaaaagtatgaatatgcatcaattatattcattgatacatcattcataatagtaaaactcagggaaatattcatttaattactcaatgaattaggttgcaacagttcaatggaatattacatagccattcaaaaggacgatttgtataaagatttattaatacagatactttcgcacacatgcatatatatacacacagttggaagagtatacatgcacacatagatacatactgaaaacacacacacacagagttatcaaagtttcgctgaaacattgtggttgtttctcggcagtgctccctcaacaaaggagaatctcagagccttttgtttttctattcatccttttattattatttgatatttgattccttcacattcaggatatgttatctttgtacacagggaaatggactataagatattatatcccatccttaataaattgaggaacaaaggcatgaactacattcaaaagagagctaagctagagtcagggattcattacattttgcaaagaattctaagaccaggaatccagaagtttgatatgacatgccacagacaagatattcaaggtaaggaggaaacataaaacattagtaaattcctcagtgccaagcaaacacagattgctggcttgaaataatgttttagagccaaaaaaactctgctggaacatctgttccatctatacattcagtttacaatagtctcagcaatttagtttgcagatccacaattaaaagaaactgggagaagttccaaaggaaagcaacccccaaaaaagtggttaaatggttggaaaatgtgttctgcaaaaaacagcctaatgaagctgttcttattgcagggacgcaggaggaaaacaaatcagaactagtaaggaagtttatgttggatttcatataaatcaagagctaccacttaggcaaaacacagtaataactgtttctaatgataaaatttgaaagatcaaactaatagcaatgatagtaagagttaggtctttgaaagaattgtctaagcataaaagtccaaaaacaagaaataacctgccaaggaaaccatggaaactgcttctggtgatgtcaagaacagcattgacggttgtctttctcagatagtttgtgtatggtgttgtccagaagcatggtggatagcttacaagatatctcaaaaatcctatctgaaatattgtgctttgaaaacagagtaggtgggatggcagaagtccccagaggtgtttttctcaactcatgtgcattcatacagaagcctgtacatcctagtaactgttccagcacaaaagaaatgtaaagaaagtcacaaaaagtgtggaggaagattttagagctacccagagcgtgagactccaaacagaattccataacaattttccatttgcagacggcagggaatgacaggcacactaacagttactgtacgataagatgaagtgaaacaaatgctagaagctgggaaagcaagaaaaaaaatttttttaaagaatgtacacaattaggccaggcacagtggctcactcctataatcctagcactttgggaggctgaggcgggaagatggcttgaagccaggagttcaagaccaacctgaccaacacagtgagatgctatctcttaataaataaataagtaataaaaaagaacatacacaattttagcccacaagccctagcagtgaatgtgggaattgacagaaagatatagaaaggatgaaggtgaagaaacaaaaacaaaaacaaaaaacatttgcaaaaccagcacatcatgactgcagctgcaaagaacctttctctgctggaacctatgtggaaacaatggtcattgacatagggtatgctcttcaaagaaccaataatcattcaacaaacaaaactagaatccacagtttggatagaccaaagcagggtggccactccaggatgcatacaatagcaggcagtctttaagccatctacttgaaggtagagaggactcataagttacgtacctgtcttcaaacacagctcatcaaagtcatggcagcaactggtatagctcttacacaagttgtcacagcgacaatcaggaggtccagcctcttgaagttcaaagcacctgcccttgcaagatccggagatgttggtccagggggagtctgatagcactgcaaagaacaagaggcaaaaacaatggactggagagtggtcatgtcaccatggaaaggtggcactgggaagctgtgcggtgtgatgctgcagtggactctggaggagaacactggctccattacttactacccatgtactctgggcaggttgcccaacttccttgttctacgatttcctcatctgtaaagtgggggactcataaaagtaactctatgttgaaaagagaattaaatgaatcaatccatgtaaaacacttagccgcatgtcagacatatagaaagagtaacaagtgttggtgatttgttcaattactatttataattattattactgcaaatctgtgatgattagtgcccctgtgggtgctaacgatgaccacagagaacagtaccttgatctatatccttagaaacaagagagcatgtccctatttaaaaatccaaaactttttacaaggaaaattcagctcaaatgttccaagaacagaacgaatatatgagattggaatagaagacttttacagtttcagctagtgttttacaaatacaagctctataatctgggcttctcaaaaaactcctccatcaatattttcacatgatataggtgtatatcagaaatcaaaagaatcaactaaaatttggggaaaaaaagaattcagtgagatcaaaattccacaaatttgtaatatgcacacaatatagtttcaaaattaaacagaagtttcattctcaatagggcctaaatgataaaatagctaggtattttatttggtataaatttaatcatatgtatgtagaaccaacatacatgagaaaagtctaccaaaaaaaaaatttttaagatctaattaaggtgggggcaaggtgcctcatacctgtaatcccagcactttgggaggccgaggtcggtggatcatctgaggtcaggagttcgagaccagcctggccaacacagtaaaacccagtctctactaaaaatacaaaaattagcccagcgtggtggcaggtgcctgtaatatcagctactcgggaggctgaggcaggagaattgcccgaacctgggaggcagaggttgcagtgagcagagatcgcactattgcactccagcctgggtaacagagtgaaactccgtcttaaaaatatatatatatatatatatatatgatctaattaaaatgaaagacataccaccttaaaggtaaaaatatcaatattataaaaatattaattcttcctaaacaaaccagaagactcagtgcaatcacagccaaaaatactgagagttcatgaaacttgaaaaaattttaaacacttatttaaaaataaaatattttaaaatagaaaacctctgaaaaggaaaagtaatttgataaagactagatagcaaagtatattctgaagttaaataatcaaagtagtctgatactagaaaataagtagattaatgttgtggatgggagccaatcagtaagtagggactataaataattaagttagggtctcatctcaatatacaaaataatttctgctaaatggaaaatataaacagcctcataactgtttccaggaattaaaatttttgtaaagtagaatataatttagaaagacctatcaacatgtttaaatgcttataaatgtttcacccagaaattctattactagaaatttaccatttacacatatttgcaaaagtttgccaagctacatgtacaaaaaatgtccattgttcattgcagtccttttattacaggtaaagagatcctgaaatcaaccaaagttgtttttcccgtcaagaaagaaagaatcgctatatccataagtggactattgcaccgtaagaggactattgcacactccttaaaaagaatgagtcagatcggtgtaggctaatatggaaagatctacaaaatatataaataagttgtttaaagaataaatacaggatagagtgttatatattagactttgtgtttaaaaatagagataaacagggcaataaggatagaaatgaagatagaaataaaaacagagccaaaactagagacgagtgagagacagggtagggcagaaggagggagaaaatgtccaagtttgcatcacgtttttaaaatgcaggtgtgaacaaactttttccttctgtaagaaacaggttatggaattacatttagggaaaatgagaaagaaagaggaagaagatttttaccttcctgatgtttgaaatttctaacattctacaaattcacaggtagttgcctggtctttttgtttgcttacttactttctctttccttctctctcattatatataaataccatacaatatatgtgcgtgtgggtatgtatatttatgtacaaaatatatactgtataatatatgtctgtgtgggtatgtatacatatgcacaaaatatatgtcatatatgtatgtgtgggtatgtgtatatgtacaaaatatataccgtataatagatgtgtgtgtgggtatgtatatatatgtacaaaatatataccatataatatatgtgtgtgtgggtatgtgtatatatgtataaaatataccatatatgtaaatatcctaacaaatattattgacatgcgatttataattttattttcttatttacatgcttatgaatttttcattttttataattcatgttttacttttaaaatcaagaaaaagcaagaagcaggagaagaacagatgttaaatgtcacttctaggttcacccaagccatttatctgaacattctgctcatcccttagtcctttgtcctcgttaaagtcttaaagtcagagtcatccaatcccagcctttatggcatcagatcagttcaactaaagcaaacagatttaccagatcatgagatgtgaaacacttttgcatggttgctcctaggattttgaaagacatacaaaccgtacgagttcagtttagaaaataatattcatttccaatgcagtggtccataaagcacatttttctattgtctttgaccaacctatcaacagtgcatgctgaaccataagaaaccatggaggcaggaggggttgagaagtaaaacaaaaaaaaaattacaaaacagaaaaaaatagagaaagtcctacagtaaaaataaatataaggaaagtacttacaattgaatattccttaaggatactgcttagatagactcatttcaacagcgttctagtaaattttcagtagaattcattcccacgagctgcttaaataaataagcttagctatgctgatagctgagatacttcaaagagatctaaaggcaatttgtttacagatgtgcggtgttcctgcatgcatttgaaattgtcctgcaaccacgcgccttgctttccttcatcatcatttcttccctatttctttcttttttttttttgagacggagttttgctcttgttgcccaggctggagtgcaatggtgtgatctcggctcactgcaacctctgcctcccgggttcaaagggttctcctgcctcagcctcctgagtagctgggattagaggcacccaccaccatgtccagcaattttcgtatttttagtagagacagggtttcaccatgttggtcaggctggtctttaactcctgacctcaggtgatccacctactttggccttccaaagtgctggggttacaggcttaagccaccacatccggcctatttctttctttactttcagagtatctgtgtgaatttttagccacatttaatctttcttcactcattcacctgatttttactattttcttacaacattaatcattctctaaatttgtcctttgctttgtttttggaaaataattgaatctcacttaatagtcggtccctatcagttacagttcttgccaaacctaaagacaagcaaaactaaagacaactttgttagagttagccttacactcataatgccaagatgtatctcaaaagaagtactgtacttaagatcaagttattgacagcttcaaattagggtatactcctggggctgggtggattaggatatacctatgtcaaaattcattctcggatgatttgaattcagctgagaatgacaggaaagaaaaagggaaggtagtttgagccatatagaacctcttataaaccaataacccaaataaatttgagctgctatctctttttttttttcttttttttcttttctgagacggagttttgctcttgtcacccaggctggagtgtaatggtgcgatctcggctcactgcaacccccgcctcctgggttcaagtgattctcctgcctcagcctcccgagtagctggaataacaggcacccgccactatgcccggctaattttttgtatttttggtagagacggggtttcaccatgttggtcaggctggtcttgaactcctgacctcgtgatccgcctgccttggcctcccaaagtgctgggattacaggtgtgagccactgcgcccagccatgctgctatcttttttttttttttttttttttttttttttgagacggagtcttgctctgtcacccaggctggagtgcagtggcgcaatcttggctcactacaagctctgtcttctgggttcacaccattctcctgcctcagcctcctgagtagctgggactacaggtgcccaccaccatgcccggctaattttttgtatttttagtacagaccgggtttcaccgtgttagccaggatggtctcgatctcctgacattgtgatccgcccaccttggccttccaaagtgctgggattacaggcgtgagccaccacgcccagtctatctcttttaaataaaatacagtgagtgtatgatgacactcagtaatgccacacactcctgtgtgcaatggaaaagaccatcttgatgagtgtacaaaaaaaataaacaaaatgattaaattaacaaataaataaaatagaacaatagagtggaatattcactctgcctttccagggtctattccgtcccagccatcttctttcacgacaagctctagtcccaactgttttcctaggagttctgcaatccaccttcatattctttttttaatcattttttatggatgaataatagaggtacatagttttggggtgataatacattcatgtagttgataaaaatcaagtcagtatacttggagtcttcacgttccctgtccttctccctacacccagcctaagatgtttaaaatcaagaaaaatcaagaagcagaaggagaacgatgttaaatgtcatttccaggctcgcccaagccatttatctgaacattctgctcatccctcagtcctttgttcctgcatgcatttgaagtttttaggacttctctctttattgtacctgacgtaatgtcaaatagggaaagattatccgatttgttagaagtctgagttttaaaatctgttgtcttcctttacttgacctaaatcaagagaacattgatgtaagcacttcagatgtgtaacttattgagaggcgggatgaaaactgaaacatcaacaaacttgtggtatcccaaatttttcatcattactgagatggccgtaacagcgcagaaaacaactaaaacaaacaaaaagtactctccaaatgtatcaaggcagaaatatgtgataagtatgatggaggcttgaaatttcttatgaggcatttgctaatacctttatgagattcaaattctattgccgccttttaaaatacatattcaaatgatgttattttacttcaaagatgcaagtcagttccagaatcttgaaaaacaaatgttcatagctttatatagtgttcttttaaaaaatagaaacctcaaattttaaaatacacataggtacatatatgacatgtataacaacaatgcaatgcatttcttatttttcacagaagcataatttcatgatttaaagaaacaccaatgtaaaacatacgttatttcattcaaattcataattctgacagaaacaggtacaattacttttacttaagtcaactttatgtctaaaatattccatcttacaatatgtatagagaggtagggttgtagaattctagtgccggccgggcacggtggctcacgcctgtaatcccaagactttgggaggccaaggtgggccgatcacctgaggttgggagttcaagaccagcctgacaaacatggagaaaacccatctttactaaaaatacaaaattagccaggcatgggggtgcacacctgtaatctcagctagggctgaggcaagagaattgcttgaggtggaggttgcagtgagccgagatcatgccattgcactccagcctgggcaacaagagcgaaactccatctcaaaaaacaacaacaacaaaagaattctagtgccatctgttccataagatacaacaaaactattgatgatttaaatttttggaaggagcctaaccgatgacaaaagttatggccaaaacattacttgatctaaggctcccaatcatatttccctctaaatgtcccccgtaaagatgcaaatactcaaatctggatgatggccaatagaagaggcagtatttaagtttggaaacatttagcttagcctaaagggggaaggttcttctaagctttgtctgctcctgtttatgatactgctctctatctgttcctcccattctccttggttcttagcccaggtatttcctgaaagtgagagcaaaaccttaaaatgtgttaccagctgtggttataccagctccttttctcaagagcgttaaaacaggacaagttcccttatgtctgctgccctgtttgaagcataacccacagggcaaggcagaggacagtgtgcgtggcattcaagatgctgcccagctctagagttaatactgtattatgcctcttctggagtatatggttcgttctttctggtcatacttttttcgtattgaatttgccattttttattgatgcttctgacctcattttttagtaaatagaacttacacacaggtctacatgtcagtatctttgcttcctaaatacataactttttataaatatccattactgcaacatcactgttctctcctcttcacagctgctaggccagatttcataaacttttttttttttaataaagaggtccacctgggaagtttttaaacacctgtgctttcaaaacatttataaacacaatggtctgacctgcctcggtgactcatgcctgtaatcctagcaatttgggaggctgaggcgagtggatcacctgaggtcaggagttcgagagcagcctggctaacatggtgaaacctcatctctactaaaaatacaaaaattagcctggcgcggtggtgggcgcctgtaatctcagctactcgggaggctgaggcaggagaatcacttgaacctgggaggtggaggttgcagttagctgagatcacgccactgcactccagtctgggtgacagaatgagactctctctcaaaaaataaatacatacatacatacatacatacatacatacatacatacacacaatgtcctcatatagagctcacaaactagaaggaaaaaaaaagatttctacgtaattgaagttaaaagttaaaaactttacttcaacatctaaaccacttaaatagaatttaatggccatcagtagcataaatctgaatgatttgcacatctgctaccaaacaataaaatgttgtcatttaaaattaaaggtattgttaactcaataaggtataagtttaaacactggccttcaaacctaattgaagattaattaaatgaattatcatatacttaacaccttatagttctcatcagccttaaaggcattttcaaaaactttttcagataaataaaagcgactttatccccattttcctggttggaaaattagatctctaggccttgtatgagttagccaaggcctggataaaattttagatcatctcactgtaactacagtatttttttcattaatgaaaggtttttcaaacttttgtacatagttttcaaattttagaagttcttttcaaaatataattttggggaagatttgctgattttattgattcaaaaatctaggctgaagttcatggaagactgagatttctgagtatgtaaactagatagaggagtctctacagttttcagatagatgaaaaatcactacactacagccccatttaacaaagaactgaaaaatctgtaccctccttagcttccagttcagataatttcattccattgactcaaactccccaatttctacctgaaatttcacataaagccccatgacaggataatcctaatgaccgagttttgctcacagagcaaatggctgatctacgtcccctttacagtttcctgcattctcccatgccaacatttaaatagcttttcattgcagagcaaaatttctaaaattatcaaatgaacataaaccttctcacttctagttccattttctgatttccctatgattctcaaagaaaagctttatccataaagttgttagtgacagtctacatttcatatgaacctatgaatttcattcacatacttttcaactttcctttcaagccactaaaaacaatgatgaattaaactgagcttttaagtctctgttagccagctattcacaagctcacaaatttccttttgtcttttaagaattaaattacttacatatcaaagaggatattctatttccacctggagacagtttctaaatcacaagtttcaataaaatagactcctgcataacaccacaaacatacacactgcaagtgcacatgagtgcacagacacctgtagacatataaagtctcttgcagtcttaaaggcaaatcaagtgggccacatcagacatatgagaaaaagatgtcaaactaaatcacagttatggcttatattttcttagaaaatttattccacccatctcaccgtctcattaacctgaatgcccattgtatttacccaacagaattataagtagcttttctcatttcatatctcctaataaatctataaatcttttatgacctggtataaaaaatcctgttcagccattatttcctacgctaacaataaatccaggtaacaagtgtgttagttaattaattatgacagtctgtttgcactgccacaaccttgaaactaacaccccagtccatagtacagcagcgagggcatccatgtgtacagaacattctcagctattgttgaggactctgagaagctatggttactaaacaactgcatgcttttgaatggtggatctcactctgatcaatccgaagctagccatatatcaataccctttgtgttccttctatttgttgcacccttggagcactgagcttcccaggatttctttggcgcctaaaaatgttgttggaaataggcatggctgcctcctccccacctagtgtcttattcttacaggcttataaaattcacccagtattttctgatgggaaggcttttctaatggtcagaataaccagtcacatgtgtcaatcgagagagatcctttctaagcatatgcagcatttaaacgcataaagatatttccactgtctacaggatgcttttacctagtttactaagtacatccttgatttttattcaggagaaatcaaccacagttcctaaaaagcacataagctacatcaaaagaaaaattattcaggcatatccaaaccataaaattcagagttaggttgcattgtattctaagactaagcttcacgtggttagaagtttaataaattattttagatgatatcataaaggcctaaaataaccaacgacttaattaaataattcaaggagcaaattcgtgtagcccacttaagaccatttaggtttataaattataatatagaccatactacttttctagaagtggcatttattcattagttcatatagctattcttataacatggaaataatttactatacacaaaatattttcaaagactaataaatccaatctatacttttcaagttttccagtagtgagcacagaaattcaagaggcaatgaaacagaataattcctgggattttttttttttaatccagaaagaaaagtagaaatcatctaagtctgctcctcattgtacagctaaggaaacagacttcacaagtgacttgcccaacaccacacagcaagttacaggactccagggtaccagcctaggattttaatgactgttttccaaaagaagtcacctttaaaaataatgagtgactcaattttacattcattaaggaaacagcatttaattctttcaatctcagttttagccagagtaatatattaagaggaaacagaaaaaaaaagttccctttagtgttcattgaaaagaaccagcagttggctctcaagttgctagctttcccacatgaccatgctaaggatctgattcccctgtctgttcagtcacagtcagtgttaatgggagtgaaaaagaggcctttgaagagagcatttgctgcaaataaaaacagcattctctagctcagtgatccactgtcctctgcctccccaacagaagacgactcattttgtccatttggctccctggggctgcaagttttgtgatctattttctcactcttaaccccgccacaccccacttcaattcactaattcacttctaatattattctttcaacctactggcatgattcaaaagtaacttaattgatgtaaggaagatttagtattccatcaatgtatgtgtcctaacccggttgataataaaatttcaagctggctaaacagaggcaagtgatggtctttcataacaatcagatcaagacatacagagaaacacaaaattcacaggaagacagacaaacatgctggaatgtcaggaaaagtccagaaaatattgttccctagagtgcccattacttaaaatgtaattttttatttctaaaaccatcagcagctccaatttccaggaaattaaccaactcattgcttaagacctggtcagttaagccccctctgtctgcacaaggagctcctttataagaacactgtatgggaacactacttatggtgtagtgtattgtaaaaagaaactctttcactttggttctattatttaagtcaaggtacactattaaaacttacctttcctttgccataaggacacacaatgaggacaaatcaatcctgaaaactctttaaacacctcctctcttttatgtttttccaattttaagtaaatcttaaagtcctaaatttctgaagtttcataaagatagctcactgccttttttacttccattcctttttcctacatcagaactttctagtggcaaatactacatcctatatcatgtgacagcaaatcagatttgggtagctccaatattaaaccaacacctgttctcaccacttctactttagccttgtctgtgaacaagagttttaattgtatcctaacatttacaaatttgagtacaaaaatggaaatagccagttatgaaacaatcataaatgttctctaatgaaaaccacactctcccacctgaattatacacataggtggttttacccagagaaatttaggactaacttagttatactgcaagattgtattaaaaataaatattttaataagcttacattgattaccccgtatgtaatatttttaaaaaattgaaaatgcaaatagttttgacacttacctgtaggaggaccttcctcccatccttctgctctcttaattcgatgtgcagtgaatcctaagcagatattgactccaacggcaaaagtgaacagggatattatctaagagaataaagagaccaagttgtcaaatacagctggagaagactaaatcaaattacacaaaggtgattcaaatggcttcaatatcaacacccaatcctaccacttccaaaatgcataataaggtgctatcttaatttgcacaacaaaaaggaaaatgccaatcagtcactgattctgaagatcaagcatgtcccccgtcattcctccgttctcccacctgacacgactggaacgagctcctccttgccatgtcgaggattcttggaaagccttttgcagcgtgttctctttgccttcacggagtgcactgctttgaggctctgggtttagtctatt

SEQ ID NO: 1364 - DNA, 81787 bp, Homo sapiens
ccagaaaaaactgaatgtgtgatttattatgtttaagattggtttataaggcttaaatatatctgtcatagttaacagttaacagcaaataaaggcaactttacaaaatcagtgtttccatacagtacaggactaaatgtggcaactgtgcattggaaaattaatatttcctcaatgcaaatatcaaatctgcagcaccatttagaagcttccactaaaaactcaagctgcagtatttattacaagctctactcagaacacaaggctacctaaatcaagcattagagaaaaacagtggagtcattcaggcataatatgtcagatttggtacaggattaaaatactaacatttttaatgtcctggtttcaaattaataaatacaaaaacaatataaaaatatacaaccagttgataagactgtactgcagatgctcagaaagttaaatctcgctctcatatgtatgcaggtatgtcttgagtgtcaggatttctgggtagctgcggctggtctttcggaagaagtccaggctggtgagatgttcaatgtcacgcaccctagctgtgtgcatcttcatgagttcttctacccattttgattcgtcctctgagctctgcaatggaaacagaacaaaatcagaatcagaattttccagaggagtttctccaaatggtcagtttactccaagtccacaaatgacctctgtgcactcttgcacacagagccaacgcatgttgatccttcctggcctccctgccactctaccgcattcctatgggtaatgtgccacaaatacctgcccttggctgtaaacattttcaacagcaattaactgtaccaaataaacgagacatgtggtgtcagagggcatttgactcaataggttctcagaacataaatcaaaattaggaaaaccaaaggccctagagaattcagtaatttgtttcttttccaagctgtcaaattgcaatattgagcacagagtacaagtaacttggaatatgcttctgcttcccaaggaaagtgaagaacttaagcctaatgcacgaaatgatgtgtgtgcattcctagtttttcaaaagaaactgctgcatcaaccacgtcatctactagaatgcataaattgctatttgaaaaatgaggtcaactcgaaaccactcagttgacacatctggcactctagggcccaacaggccagagttggaaatgaggctgtactacttcttggctatgagaccttggtcaagctacttgacttttgaggcctcagtttcttccttggttcacaaggataataatgcttacttctgcagctccctgggaggttagggaggagaggagggaagaagcggggggaaaggtaaagcaaggaaacacggaaaaaagaaagtgaatctctgcctcagctgcttgccaaaaattgccccactgacacaagttgcagatgaaagacattcagatgtcctgcatcaaacaacttatttcatgtctaacttgaaactaaaaggtaattcaggggaagcagttctttgcatctcaaaaatagcttctttcatttttgtgggaagttgagggaaagagtgagatctgagagccctgtgaatatggagcagtgtctactttcattagtagacattgagcaggacctttgcaagtaattccattcacaaatgcctctggaattgcaatggcttccaagagcccttctacaagttgaagggtggctgcatgtcctaggtctgggaatattcagacatgccctcatccaactctttaccaccagtggtctcagtgaactatccaccaaagcccaagaacctgcaatgggctttctcggaaagctccaacccacacaaacctggacagggaactgcagcagcttgtgccagtgctaaatatgttcgggagggtgttggttcaggaaactgatgcctggccatctcaggcaaaatgaagaaaggggaagaaattgctttgcaggctggggaggtaagaattttaaccttcatgtcccaccctcctaacccaacctaaccaagatctctgcgattcacaggaaaggaaagacctaaatataactctacccacaatggtactgaccagtcctcagtgtgaccctataattaacgaagtaggaggtctccagatgggtcaggaccccctcagagtaagcagggcaagcatgagcctgtattttgagagaattttcatattcagctcatttgtttgatttttcagtggtcagtcagtccaatttttttctttgtaaatgcagtcattttgaatgtgtggacaggggtgaaaaggtttttcctaatttaaatgatggctagctgggattataagaattctgcaaaaacatctgtcttttgctatttctttccttgggaagtgatttgccaatttcattggagaggcagtctcttccggttctcacactctgaaatctgttctataattcatcattaggaaatactagctatgtggcatgtgaaggaaatatcttctgccttgatgttcgctggcaatccacagaagcattcgctgatgaagactgtgctgcaagatgcaaaactaagacaattcagataaaagttcatgaacagcaaggtagggaggacaggaaagactttaaaaataaagcacttagaatattaatgcaaacaaaagcacaatccatgaacttgcttgctgtcttcctcattatggacattgattcttcacctgtcttttctccctgactttctccccaggtttgtgaattcaagtcccagaagttttaaggtaaaattcacagcaaggacagcttctacatgaacaggtgacccttcaacgagaagcatgctggccacgaactctacaagaagtgcctccagactctgtgcagagtcaggaaccagtagggagaggaaaacctgtaaggacttcagtggatttcatttatcagatataaaatttagatcgattacagaacagcctttgtaccaagtttagagcagtatttttaaaactccccatcaccaaattcctctaatgaccgaacttgaacatctattccccaggaatctaggtacaccttaaatggcctactatgtatatgaaatacctttgtagtcttttcatcttagaactgtatggcaatttttatttttatcccataatacaacagtttaatgttttgcaagaatttcacctccctacaagtttctaataagactgaagctcagagaacgtataccatgttatacggaggcattacatccacctggggcttttgtggttgtaaacaaccaaaattgagagggccaagccagtaagttgataacagcttgtctctcacttgcagtttccacatttctctaccacccattcccatcatttataaaaccctatggatccttcaagtataatattgttgtcttccatccttccttttagatctccaagaccacaaccccagttcaagttctctcttgcctcactcctgtgaatcttgcctaagccctttgagcacaatgttcagtctcctccatttcaaatttatcttcctaaagcagagccaaaaacgttgctcttccaactaaacattttccttgggtacctaatgcctaaaacgtacgaaaaaattcctaaattcccaaggttctactatggaagtctgataaattggaaagaggatgggctcttggagtcagaggccttaaatctaaagctctgctcttctgctgactaaccaagtaaccacacaacatactttccccttagtagctataaatttctcaacagttaacaaaaaggcaggggagagatcatatatatatatatttgcctcatactgtggttatatgattagaaataatatatgtagaggacctacacataatcggatcacaacatgtactcaataaatggtaacaactactactactgctcctgctatgatatctactatagctactattactactactactttttaaaaatttgattccaatcaacttttaaaatcttttctcccactatttgccctcatttctaatattctggcaaaacttaattcactttctgggatatatttaaactttctaattttcttctacattcatagcctcaatcttcacccataattgaagtcaacagatcaaaaactatcttgcccacaaagctgatcatctctattgaagctattcttgtggctccttgcctttcagtgttgcaatttccatacctgttttatttgttgacccactctgtgggctgcctaggaatagtgactctgtctaacacactcttgtttctcctagagtagcttatacaacttaggaatttgagtagtacttgttgactaaagattatcttctgtagattacatctctactccttctgtcatgtgaaacaaaagcatagaccattacttctaaaatcaacctttgagcacaaactttccatcaaattaaaaggacctgaaggtttttccatctgtccctgagtgtcaagttagtacagggccaggagcatatagcatggctcctgtcttcctccctagtgttttcatgatgccatcctgcatcctagctgtctccccacaggatgagtgaatcaggagtcatctgtgctatctgagaaaacagtgactgctacacctccatcataactagtagcaaacctgattagtaaggtatagatttctttctcgcttgctcttgctttgtgtgtgtgtgtgtgtgtgtgtgtgtttgtgtgtgtgtgtgtatgtgtgtgtattaaaaagttttcatggctgggtgcagtggctcacgcctgtaatcccagcactttgggaggccaaggtgggtggatcacgaggtcaggagattgagaccatcctggctaacacggtggaaccctgtctctactaaaaatacaaaaattagctgtgcgtggtggtgggcgcctatagtcccagctactcgggaggctgaggcaggagaatggcgtgagcccgggaggcggagcttgcagtgagccaagatcacaccactgcactccagcctaggtgacagagtgagactccgcctcaaaaaaaaaaaagttttcattatgggccacgcacaatggctcatgcctataatcccagcactttgggaagccaaggcaggtggatcacttgaggtcaggagttcaagaccagcctgaccaacatggtgaaaccccatctctactaaaaatacaaaaattagctgggcatggtggtgcccgcctacaatcccagctactcgggaggctgaggcaggagaatcacttgaatgcaggaggtgaaggttgcagtgagccaagatcaaaccactgcactccagcctgggcgacagagctaaaaaagaaaaaagttttttaatatggaaatttttaaacatccagaaaagtgaagtgagaaataaaattccatgacctcttaccaagcttcaacaattatcaaaattttgctagttcctacttttttataaaattttgtcattctccactttcttttgcaaaatgaaaaacatttggacatttatttctcaaaattgtacacattgatagaattatgttaaatgcacacatatattgaaaaataaagagtcattagaaggcaaaattcctacatgttaagcaaagttctgtttggttcctttcttttttctgtttagggtgaatgctttataataagtatgttctagttcaatgatggaaatataaagtaagaaacgaaggtgaactatggaagcaaatcctaaaggactctctctgtaaactcacattgcagctctcctcgttgtcaggccggtgaggcaggatgaaggaggacacagagagagggccgtcacacttgtcggcaggctgagtgaaatccagacagctggtgatgatgctgtagtagtgagttggaacaggaatggaactgccttccacgtacctgaaacaggaaggtaaaacgaagtcacagttgatgagttgatgttgaagctttcttttttaaatggtgatcaatgaatattgcctaagtcactaaaattaatccccattcaattgaatcatttttcacttctaagcactagcccacttctatgtctttgaaaataatgttttctttgcctggaatcccctcactcctcaacctggcagagtaagaaagatattccaggcaaagaaaatggattgatctaagaattggagacaggtaatggtgaatagaccaatgcagtagaaatgaaaggctggaagcgtcaataaaagccaaattatggtgggttctgagtgccaggatatggactggggcattattatttaggtagtaatgctccattaaaggtttttgtgctagggagtgtcattcattattagttccatgtttcaggaagataactttcctagagttgtataaaatggacaggggcaagagacattagagccaggagaataatgaccctttcaagctacaatgagatgcagaacttgatacaaagaactcatttgccaaaggaagtactaaggaccgagtgctaatgatggacctagaggtataaaaaatattttcctgtagagatcagtacagaaattcataattccttgcctggttttctattatcttaattttattcattttccaaatattaaaattacgatttaactactaatttaattttggctaacagtgatcagcaataaaataaatgtgcaatttacacaaaatttctcttcagaatgactggaaaagaagtaagataatttctatcttatttatctgtatttataaaatagcaatttattctgtaattatctctaaatcacaattaaaccctcttatactctgggctgctgattgtttcatgcttgtataaaattaaataacaacattctgaatttgtcaacaaatttgttgacaaattcagaatgttgttatttaattttatacaatgaaaatacatcccaatcactctaaatcttgctttctccactagactgtggggtcccttatgagcacagataatggcttttatatgcccaacagcaccaaagagacagagacaaccagattcaatccaagtccataggcactttgctactgagaggtactgactcagaaaatctaagggattcttaagtcccacccaaataatgaagataagtgggaatggtcatcttcccattgaagagctgttgaagaaatgactaaacaaaattaaatcctttaatacatttttttcatagaataaaaaagtgcatttatttaccacaaaacccaaaattccattcccaccaccaatgcccatttaatcaaaagaattgataaattcaggctgggcacagtggctcacacctggaatcccagaactttgggaggccgaggagggtagaacacttgaggtcaggagttcaagaccagcctggccaacatggtgaaaccccgtctctgctaaaaatacaaaaattagctggatgtggtggtgcatgcctgtaatcccagttactcaggaggctgaagcaggagaatcacttgaacccaggaggcggaggttgcagtgagccgagatcacatcactgcagtccagcctgggcaacagagcaagacgccgtctcaaaaaaatatatatatatatatattgaaaaattcaaaaaacttaaggggtgtcatctcttctctagtatatgaatatttgaaaaacttcttgagtgagatcttgggacttaaaaatcacacactgagtagaaatgaaacgcttactgttttattttgtcttctgtgtcatgtaagccatcatagtcatagtcgaagattggtccacttatcacgttaactccatttctttccgaagcatatttcttcaccaataccctttggaaataattccagacccctgtgcaaagacaaaaatccaaaaatcaattattcatgaagaaaactccttactctagccaaattctctctaggatgcatgctacgagccaaatctcacaagccaagagacaagagagctgtcgtgattcatgagatgaatcaattctatggcattaccagtgtgtgtgtcatttacaaaccagcaaagggaacagtgtagagctatgaaacaatggtaggggagtttaacgtagttcaaaagtcaggaaaggatcctcccaagctgagatctgaagcatggataagtaggtggtgtttcccaggcagaacacgccaggcagagggaacagaatgtgcaaaagaggaagtatggtgtttcagagtaatgaaaataaggccttactctttcttctcgtccttcatatctcatcaatatgctagttcccaggtttaagctttacccctgacctttcctggagatccagacatgttatccaaccacctacctcctaatgcactggaatacctaatattcatgtcaagcaaaagaattttaatgttccttcctaatcctgccccaaccctcgccttctccatcataatcaatggctctggcactcacccaggtgtttgggccaaaagcctaagagtcatccttgctttctctcctagctatagacacatgtgaacaattcctgtcagtgctatcaccaaagtacatcccaattatcccaaatttgaccacctctcatcttttcactgctctatcctggtctaacttaccatcctctctgagtgagctatcacaccacaaaagactattccctgggttccctgtgaaatgcttacttcccttgtaccttgtagcccactcccccatatcgtagccagacggagccttttacaccataagtcagactgtatctttctcttgcacgcacatgcacacacacacacacaccacccatttccaacactccagattatttttcattgtaattagagtgaaatcccaactccccaccatggtctttgcctacctctgtgactttacttcctacccctttccctatcactcgcaagactttcttcctgtcccctgacttttcccctaacttatttcaggctaagcttttgcacttgctctttccttcgtttgaaaaacattcctggatctgtgcatgtctgctttctcctctataattctttctcactttcactgtcatcccctgcagagaactgccttatcctcctgcttctaatttccataatggccaaccagaggggcagaatggaaatggagaaaaacaagagaataacagaaggagacaggataggcaagcaatgggttggttctgaaatattagatcgaattcgccatgctgtcttcaacatgggtgtcatgcggttctggctgttaacccctcttccctccccttattaaaaagcacctggccatgcttctcatactgcttcaattgctcttcctgccttctgaaactctgaatggcagagcagcccacaagagccaaaataccttagataattatttgcagtcaagaaagaagccagacagtaagaaaggagttcaaacgttaacttaagcattaagaaaaaatggagaggaagagaaggaaagaaacaatgagaacagtcaaaaggccaggcctgcagaaatgtggcatgtgaaaaaaccacccccctcgtggagaacagcaagctctctatgaaaggccttctccacaccagcctcagggtggtactgtgtgttgccttgattaccatttggtcaaaaaaacacatcaataaagaataaagaaatccagagaaccctgatttgcagaaattaaatgaagctgcattctatgtaatattgtgataaatgtaactatgtgagtttctgaaatgcttctcagttgggtctgagaacaaaccaagaaatctttttaaaagcatactttaatttttcactcataagcaataaattctctttgaataaaccttcgtttactaactaggacatcaaataaacatttttttctctaaaccgtgtggcccttttcaccaatgttaagctgcggaggcccgccactgtagctgacactccacaatcgcccattcctattttgagactccctttcagccctgagagttacataacacagcctgaacctcctccatcaagttgaagcacatagaggtgcttccttttcctacctttcccataacgatttaagttctgttcactacaaatgtactgaaaggtggtaaaagctacttcataatgcttactctatctttgaacacatggatagataaaaggatggatgggtggacagggggatggatggatgaatgaggatggagacatagatgaatagttaacagaaacaaaaaatgcagtgctttcgacattggataattaagtcagaaatccatataaaccttagaggtcatgcaatcatatctcttaatttcacaaatgagagatttaatgacatttctatgatcacacagcctgtggtcacactccaggaacttggctttttgtgcccgagctcattgtgcctatacaattcttgacttcaccagcatccacaaatatttatgtcaggtacaaagaaattacaaatgttcaaagaaactaaaataattggtacaggactaaaatcatctgaaataaacactctgatgattcagaaggtcctttcggctcttgctgggtttcagggccaacattcagaaaatgttatcaccccaagaggaagaggtgctactggcttttactgcaatgctcaacaaataaatatagatgctgttaaatatcaagtggctttcaaaatatagtgaagaccctttttaaccattaagataataagtattgaaataaaaataacaaccatattagaagaaaaacacaaacttgggttagttcagtttctaccatgcatgacctgtggtcactttctgtgatatcaatttcttaattataaaccggggataaactaccagccaaccttcctcacagattcaaattttggatcaatgtagaaagtttacatgaaatcaaagtttacatcaatgtagaaagtttacatgaaagatcctcaaaaattataaaggttaaacacatgaaaagtattcttattaaaattaacagaggtagaaaaggtaaggggtaaatttagaaatgtttattttcataaataacagtgtattaggtaaatattggacttacgtttgaaagcaggatacattggaaccatattggttacaaggaatgcatcatatttagcctctggtgaagagctcagatctaaacattaggaaaacaaatagtatacgttgcttaccaaaatctatatcagttaaaaaaaaaagggagaggggggtagaattttcttaaatggtccaaacaacatgaagtaaatgaatctactcttttattcctactcctaactgcgttatacaacatgtccttactcccctcccactcagtctcttcttcactcaatagctctctcccaagagccatttacaatgtttttttcttactgtctacttcttgagtctaccaacattatgtaaaataactccttgatttcatcagtgccatttagacttaaaaaaaaatcatcaaggtaatgagagatggtttaagggcttcagatttttttttttaaatatggaatcttgctctgtcacccagggtgaagtgcagtggcctgatcacagcccactgtagcctcaatctcccagatttaagggatcctcccacctcagcctccagagtatcagggactactggcgtgtgccaccagctcagctaattttttaatttttttagagacaaggtcttgctatgttgtccaggctcatctcgaactcctggactcaagcaaccctcccatcttggcctcccaaagtgctggaattactttgggattacaatggtggctcatgcctggcctcaagcaatcttaagagatcccctctatagtattacataaacgactagtgtcttaatgattcactgtttccttttcagattctcatttaataatgtaaggcgggacacagaagattcccttgcacattagaattcccctggagaattagatttttttgaaagctagtcactttttggctgattttggaaggatcccataaaaattcatttagataatcttctgagcaccctctcttgaagaaaacccaagccactgaaattccaaataccaagattgcacaatgtgacatccctctgaaggcatcagatcttgatattcttaacttacaaggaggaaagaggaatccgtaggacatctgcttatcatttttgtaggccaaacagttctgactgaaactcggagaaacacggacatcaggccggacgcaactggtcagatggtcaggaacgctggaaacctcagcctgcacgggagtcagaggcactcagcaatgccgtggctctgttacgaacggctgaaatcaaaacccctctggcttctcctatgcttgtattctgattgatagtctgactccttttttaaattttttatctttgatagtctgacttctttttaaaagtccttagttttaagtacagtaagccacaagttttcaaactttttttaatcaacataactctctttatcaaagtcttaagaaaaacaatatagaaagcagaacataaagcagaaatcccactgttgaaataataaatagaatctcattgaagataacttataaaataacactcttacaaacaatatagatgtatctcctctaaatagactatttatctgtgtgtgtgtgtgtgtgtgtgtgtgtgtgtgtagaatgtacaagaacatacgtatgtgtacacagtacaaatcaaaataaactgtatttggggcagtagaagtgttctcctcctttgtattaaaaaattttaaacatgcctcaactgccaaataacattttctaatttgtgatatatacctatttatctcatcttcatcaaaactgaaacccccaacataaaacttttgttaaaaaacaacagggccaggcgtggtggctcatgcctgtaatcccagcactttgggaggccgaggcaggcagatcacctgaggtcaggagttcgagaccagcctgaccaacatggcaaaactccatctctactaaaaatacaaaaattagccaggtgtggtggcgtgcatctctaattccagctactcgggaggctgaggcaggagaatcacttgaacccaggaggcagaggttgcagtgagctgagatcatgccactgcactccagcctgggagacagagcaagactcggtctcaaaacattagaaaaaaaaaaaaaacagatgctgatagtgggggaggttgaaggggggtgggtgagtatgtgggaactctgcactttacactcaatcttgctgagaaataaaatgtgctcttaaaatataaagtctattaaaataaataaacaaaccttggcagtttctgtaactattgggcaatgacttaggcagagtaaaagaaaataaaagaattagtgatctaccttcaaagtttaacatattcccatggaattaccagaacattgaataaaggctaattcaaaatatcttacaataaatccaacataggatttctgtcattaagaaaaaataaaatattttctaagacaaaattctgttaagcaaggaatcattgtattaacatgaggaatgtaataaaataaaaaatataaaatccaattttctcaatgacctgtttggaaacagtatatgatgtccagagtggcattaggaatatttcactataaccactttcaaagtcagtgtgatataagatatcatatctagtccgataaagcactgcaggtcgcccatagaggaggtgtctctctaaaaaagaaaaaaaataaactgtgttaggtgcatattaaattttacatcaaatgttaaagaaatgttggaagagtcaagttacctaaaatggctagcttacttattattaatatagcaccttctccttaatttaatcaagctagttttcctaacacttttgtggttgatctgatcacctaaccatgggtcaagctttacagttatcaaaaccataatgtaaatgctgtatttacagaatgctttttttagttgtaaagaatttacaatttgtatataaaggaaacattatgtaataaattttgaaatgattcagctgaatggaaagccaataggattggatttctgtagaattaattattttgacccctgaagaggcttatcaggtacaccaatgatttaattaagaagaaggcacacattgatcattatatgcatacagcaactcaaatatgcattccttcagcataaaaagtgagtagtaatgagcatttaaagtaagcagctttgtcatacagaggaaaagtctttaggtaagaacttaaaggaacatgtatagataaaataagtgggcattcaagagggtcttctaagtacagaagagggaagttcatcagttaccaaagaactcaatgaagacccccagtgcagattcagacctccaaaggaaagctctcttcttaggaaaaaaaaaggtctgaagctttactctttgcggaagaagagatgggagttcagtatgaaaatcttcattccacactctgcaataaatacctggagcttgatctgcccactttggataggctaaagtcaaaacttccacagattcttggaaatgtggggccctacagaccaaaatatttagagactgaggcttaggcaattcacaattccttaagtgataaatttaaaaaaaaataaattcttgtactattttttctactagagaaaatcagttctgaaaaacacttattaaataatgtatacatgttgctttaattaaagtcttaccattctatgcaagtaatggagaaaagtcttcgtagaatactttgcaagaccctcccagatagaactgcggatttgagacaaagcggcccacactattacaacacaagcctgttctgggtagttcggctgctccagcattgcagtaaatgtagaagccttagttaagctgccaaatttggggacccacccctaaggattagaacataatctgacaatattaaataaatgaaatataataaacaaataaaacaccagcaaatcgtaacagtagtacttaggggcagtaaaacaacccagactttccttcaaaactcaaaccaaaccttttctaggttcaaaatttccattaatgttttccttgttttcatttctgctgcctctgaatttcctggtttcagctggaagcagaagtatcaaaattctttgagaagctattctcttttcatcatttaagttttcatggttaccacacacagtcctccaaactcaaattcaagcttggcatctaatcgattccattaggggacaataaaatagcagccatgttcccatacgcaatacccctccctagagcaaccaccaaacaaaaatcttggacaatctatagtctctactaactctggctcttcctctaaatcctcctcatttctaagcattcaacgtaacactctattccacaaaggctaatgtatttgcaacactctcttcacaattgttgttagcaacattacactatcatatatgctatttcctttctctctaccagaaataacttctccagtcttcgccaagtctgtcacctatctccttccaaatgtatccattattcttcatcatcaaacattgagcgccttggttgtgccagaccttgcgctgtagaatggaggtactgggcaaagatgattaagatagagctcttaccctcaaagagctcacaagtcaaagggagagacaaacatagcacaaataacagatgccatgtggtctgcaccatattaaagatagttacagagtgtgatgggaatgcagaggatgatgaatactggaaatggagtgaaggtggcatcaataaagtcctttaaggagcatatgaagttaaaccaggctggccccatgttacagttttatgcctgttgccctggtataattgttaatagtgtcccttttcacgctcaaaagtgtatgacaaatattcagccctcatggaagagacatgaagaagaaagggcgaggggcccaagaggggcagagatatcttaagattcattttctctgccgggcatggtggatcatgcctggaatcacaacactttgggaggcaaaggcgggtggattgcttaaggtcaggagttcaagactagctggccaacatggcaaaaccctgtctctactaaaaatacaaaaattaaccaggcacggtggtgcgcacctgtaatcccagctactagggagtctgagacaggagaatcgcttgaacccaggatgtggaggatgcagttagccaaggtcatgccactgcactccagcctaggtgacagagcgaggctccgtctcttaaaaaaaaaaaaaaaaaagattcattttctcctgaaaggtttcctcaataaagcttctccatctctactcactctactgctctacatatatagattcaacttgcttcagaaatttgggttctggccaggcatagtggctcacgcctgtaagcctagcactttgggaggctgaggtgggcagatcacttgaggtcaggagtttgagccagcctggccaacatggtgaaaccccatctctactgaaaatacaaaaattagccaggcatggtagcacacgcctgtaatcccagctacttgggaggctggggcagaactgcttgaacctgggaggcagaggatgcagtgagccaagatcgtgcgactgcactccagcctgggcaacagtgcaagactctgtctcagaaaaaaaagaaaagaaaagaaagaaatttgagttccatagcttccaagctattgtcataactgcaagttttggcacacagctggaacacaaaagtatcactgactgcctttttctcaattattactgagcaaaaatagcataataaggggaaaaaatacagtggtttttacagcctcctaaaaatccaaccaaggtccccaatgacccaaaaaaatctacttgggtcttcctggagcttaacagtttcatctaagaaagagggggaaataatctctgcagtaagaaacacagattttaaggtccagaatcaaaatttagattttattttttcagtttatcaaagtatcaaagaatcacagattcagagtcatagcctgactctcctagtctttatgacatcttgggggagccacccactgcatttttgttgagcaaaaagtctctctactcaggccacaaaatgtacttgaatcttgttctcggcacacattgagatctttatctcgagaccagcaaccctggagactagcctgcaagcctctgcttctgcaatatgtttctgggatttcttcacgtggatctagtataacctggtcttcccaggctgagaatgcctgtcatggaattccagaccgagccttcattccacaccccagttccctgtttacaatagtgtctctggcagttttggtacatgccaaggttctcctccagataccacacttggcaaaatactgtgaggccaatctttttaagtggtgtggacttccccagcactcattctttttgtattccaaatttgggtcgtagagactggagtttgtgttccttttccctcctcagcttcctgattcagattcccacagatgagcaggctgtcttgagagccacatgaaaatctctcctcttttttgtttttttaaaacatacactcccacaataatatgctcttaaatcttaccacaaaatctctacccaagatctttccttttcttgcatactttctcctttgccttacaagtgcctattatcatttgctgccatttcaacctcctctgagatttgatttaaggcctctctttagtgccctgttctttcttaccccaaccttgaaaacattatgctgtaatgtatcaactggataaatcctacaacagaacaataactttatgaggacaaggacttcatctgttttactcaccactgtatcttccatctccaacaatgcccatcacataatatctacttggcaaacacttgttggtaagttaatgatacatattttttttaaatcttggctttctacatatgacctgtctaatgttaccctgaaaggtacactgggcaggtcagtagtatcatctccaacttactgatgaaggaactggaggtttatgatttgcacaaaataattcagctgcatagcagcactagaatcccaggccattactcttctgcttggccttttgggtggtctccagttgggtgctggccgctgggttatttcatggagagtgtatgggaaagaagatccaactacttcccggcaggaactctgcccgagtaatgcctactgagaagctaatgaggacagtagtttctgtcaaagcatctagtatttcagaagcaacttccaaactttgatatacaaattttttgttgagcaaagagtctctctacttaggccacaaaatgtatatgaaaagcaaaattttcttttgacatattccctttgttcccactcttagaataagaagcattttcagatgaaagcacatgggcttcagtgtcatataaaactgcgttcaaatctaatctcagctctttatagttgtggtactctgtaacttaatctcccaaagctttatatctccctggaatgttgcactgtttacaggcaaaatatgtgaagtggcttgtttagttttaacccaaagtaactgcagttgtagcagttgcagttgtactgtttagtaaaggtatgggctctacctcaatactggcaaagaatattgctaggtaaaagttgttaaaattcaatctaccatcaaattcatcttgaattctactataaacaataaacaattactatgtattgatttcttccaagtattcccaaaaacacacagatacacacgcagacacaaacactcagaagcaggagtgaatgctatctccttctttctctagaacaactaatatctccaaagaaataacacaaatgagaaacattccagaattgacaagagctaaagaagatgttccctctgtagccatattcaggactctgctttaaagttaacaagaattactagtgtttaagtcaattttctttttcttttttgaaacagagtttcactcttgttgcccaggctggagtacaatggcgagatctcgactcactgcacctccacctcctgggttcaagcgattctcctgccccagtctccctagtagctgggattacaggtggatgccacgatgcccagctaatttttgtattcttagtagagatggggtttcaccatgttggtcaggctggttttgaactcttgacctcaggtgatccacccacctcggcctcccaaagtcctgggattacaagtgtgagccactgaccgcacccagctgtgtttaagtcattttcctatccaaactaacttctcattgtgtatgataaggagccaagtatacataggtgttaaaattatttttaattcctttttcacaaagatgatggtgagggctaacctaagaaaatatgaaacatttttatagcaatgtaaatagagtaaagaccaaggtgaaaataaatggtgcaattattcttgcagtgaaaattatacttggctatagtgccagaattgcttgctacaagagattttttaaattttcttttcattcattaattcatccatcaattcaatgccacaaggaaatgagttttcattgcatggaaagtcggccaagacattaggtatatgagatccagaaataacaacaggcatgcaattaagacctggagtctaccacctatctagaaatattaaagtttagcaagcagcttagatggccatttttgaggattacatttttctttctctttattttagtaaaggatttgattccataacagtttaaatatttatagcaaaatattgcccaagattggtttaacatacctcttttttatcacagatatccctgtgatcgtttcactattggaacatgcagcttttactcatgtattttgtacagatgtatgacagattttacagcatatgccattaaaacagtcacatataaatgttacaggtgaagtgtgtatagctcatgacatattctgaaaaatatcaactacttacatctgtgttttaaaaaactaataataaaaatagtacaactttacatctgtatagaagtttaggtttacaaactactttaaaagccttcatatgtattcaaaggtacctagaaaggggaagtaattgccctgaacataatacatgtgtgctcacatacatggtggttcacattcacaaggatctcctccagtagggcagacactgaatattttaaatgggaggccaaatttatgacacaggaaacaccataaaggcctgaaagaactcagaccaagaaaacatcgctttgccactgaagaaatgaccaagatagagcccaaaaggaaacaaagcccaagagacagcgataggagagagcaacaggagaaagagcattgaggtttatacatattccagcatctaagcaaggaaatgcattgcacataataagacaaatatttttgaaggctctcttgtgtcattaaatgttggtgccactaggccatgagcagacttagaatagcatgagctattctagattcccccctaatattttatgccaccactttgaagccatgaattagaaactctcagtggtacagttgtgtcagagtaaccagtgccagcccagtgtcagtattcaacaaatgcttgctgaatgtatccatgagggtttgtttccatgaaaatacacaaactttaagcttcagcggtataaaaagacacttcagggatttaagtaagaaactcacgttccactcagagcagagcaatggagatgtaaccttactaactatagctccttatagccctgagagtcagtgattcactaagaagatgtgtcttatttttatgctcttaagtttgaggtgattgtgtgtgtttttttgttgttgttgttgtttgtttgtttgtgagacagtctcgctctgtcgcccaggttgcagtgcagtggtgcgatctcagctcactgcaacctctgcctcccaggttcaaacaattctcctgcctcagtctcccacgtagctgggattacaggcacgcgccactgccgcccggctaatttttgtatttttttagtagagaaggggtttcaccatgttagccaggctggtctcaaactcctgacctcaggtaatccacctgcctcagcctcctagagtgctgggattacaggcatgagccactgtgcccggctgaggttattgtttataatgaattgtgagactggttttgtcatataaggacactgccaccaacaaattaaatgcaggaatgtttttctcagacagaaatgctttagtaccatgaacagtcagactttgaatcagcaaaatcatgggagttcaatagaagttaccataattaatttcattagtgacttttagaagagaagcatctgagtagtatttatctgccttggcaactaaatatctaaaaaacttgaatcatgagactccccatcttttgactctagcaatgttctaattgttctaattataatgacactatagtccactagaggttaggtgtcgaacattgcaaatcacttgtagagtttgtgaaagatttgtgtgccttctaccaacaatggcctatcttcaaagtgagattcattccgttctgtgccagagtctgtgtgttctgtgatcaaagggagaagtgggatgatggagatacagaaaaggaagaaggaggcagatgaagatctttaaaagaggaaaaataagtcaagtaaatcaaatcttctaccggtttcctcaactctacttaatcagattggaaagagcatatatgataaacagaaccatatgtaagctaataactcaagcgatgctctcaggagaatttgaccacgtgcatctttgctgcatgacttgtggctgctatgcttgaattctttctgcattttccatacacttttagtcatttcctggctgtttcaacatgttatcccatctactttagtaacatgtataggaggcttcccctccccttctattttcctccaattttgtgaaacttcacaatcagataaaaagagcctgcatggtagattgtgttattgctcctcattatttactgcctccacccattgccatatgacttgcaggatagagtccccgtggaaaaaatgtacttccctacaccattggtatcatgtgctcagctttggccagcaaactgtgaatggagtgacatatgcctcataaaagcagaagcattaagacacagtgcacagttctgccactcttttccctctgtcaagagcaggacatgtctctgatgaaggctactccttcagcctgggttccagaataaagaatacacatggagcaaagctgcccttggcctacagccagcacactaaaatgggagcgagaaacgcctcttagtacaaatcactaatttttttttttttggtcatatcataagcttgcgaaagttcactaatacgtgctcgttatcattgtacgtaaagtaagagttagggcttgagatgatccttcatatgaggagggagttctgatttgattccttcggtgaatctctccctatcacaatatatatatatctatatatacactgactctcgaggtagataccttcaggataggcaccagctgctattatttatcattgtgactatcattccctttataggagtgccccacagtgtcttatgactcatcagatacaaaatggattgtgtacttttcagagggcttaaaagctattgaggggggagaaaagctattggaatttttttattacacagctggcatcttgtgtacatggaataaacaaatatcctttgccagataggtatgaaagtcactttgaaatacaaattctaattttaaacaatattgtgcttacactataatgtaaataagaagccttttcgattttcgaaaacgagaaaaaccttatctgattattttgcaaccaccccttaccttctgtagacccttttgtatgaagccgtttgttgagttcatccaacttgttcttcatgtgtgaaaaccagtaaaggaaaaaagaaagcaaatcagaaatgttctttccctctgtgcccttctgtcgacttagcaccctgctaaattcaaaagcgaactctaaactccatctatatcatacattctttcgaggaattaactgttttctctcaaactgacattctgggctccacctctagcagttctatgtttgtaagcaccttcttcaatctctgtttccttccttaaaactgtggatagtcaccacagtaccaatttcccatgtgggtactgatgatgacttgggcatatatgtgtaagtaaattaggatagcgcctaaatgtttcagattaatctctaggcacactgaagtgattcccaaactaatttatgaaatcacttttcaccaaagctaaaacgtaatgactcagcaattctgaaacagcatgagtcagcaactctacccttcactgtataccctagcatatgcgtgcaagaagacatttccagtaatgtctgtggcaacattgttgtaagagctaacatttgcaaattactaaatgttctcaagtaggaaaatggaaaaaaattcttatggtacatttatacaattaaatattaactactgtattagcagtaaaaataagtgagctaaaacttcatgtactaatatacattaagtctcaaaaacataatgataaaataattgcaggatacatatagtataatagcatttattaaaaattttacaacatgcaaaactatagtataggttattttaggaaactatacaaaagattacttcatacgttatttaataaatatataaggccaggcacagtggctcacgcctgtaatctcaacatattgggaggccaaggcgggtggatcagctgagtcaggagttgaagaccagcctggccaacatagtgaaaccccgtctctactaaaactacaaaaattatccaggcatggtggcaggagcctgtaatcccagctactcaggaggctgaggcaggagaataacttgaactcaggaggcagaggttgcagtaagccgagatcacactactgcactccagcctgggcaacagagcgagactccatctcaaaaaaaaaaaaaaaaaagaaaacctgtccaagcatagtgtgtgggggtagtctctgtttgcaccaccaccgcatccttgttgcaccctcccacaccctgctctgtggcctgggaggctgacctctagggatggcatcaaagagcaaacttgccctgtggctccctgttgggctctaccaaggggaaacatgtgaaaggaagtacaggggaggaagatgacggtagcactctcctatctgggagtgctccctgctgggttgcaatgaacaagctgcactcatcggccaaatacaatagttccttcctattcggttgtctctccatgttttggaaacttactccttcccctcaccctttaaaccttagaaggtactatgcgaaccccagggcacttcgtcactcctcattgaattccatccaccctgctcagccttggtaaattactcattaaacatgactgaaacaattcctttaaactctctctttttttcatttccttttttttttttttgagtcagagtctcactccgtcttccaggctggagtgtggtgacacaatcccggctcactgcaacctctgcctcaagcgattctcccacctcagcctcccagcgccaccatgcccggctaatttttttgtgtttttagtagagacagggtttcaccatgttgaccaagctggtctggaactcctgacctcaattcatccacccatctcagcctcccaaagtgctgggattataggcgtgagccaccatacctggcctaaactctctttcaaaacctcttctatatgggccacctgtctcccgtcgggaccatgactaatagacatgtgatccacagttgaagaaaacagaaaaagattttggttgagaactgtgactgcacagaatagcaacatgaattctactttttgtctttcatggtctatacctgtgctattcaatatggtagccacaagccacatagggctctttaattataaagtaatgaaataaaaatttgagttcctcagtcacactagccagtagctaccattttggacagcataattatagaccatgtccattgtcacagaaagttctatgggccagcactgttagccacccaacaaacttctccataataaacataaagattatttctacctttggctctaccttatcatcacaagtgcagcccaggtcaaaatcagactgaaggtacataatccctggataattgggtctggtaacttcctctggcatggttggcctgaaggtattagtgcgcaggagatgattcaaacttccatgggtcccattattaggagctggcttcaatcccaggagatctaatgaaaattaagaaaaggaggcaggtgcttcttatatttttttgatgagatatggtaagatttaaaacccttcaccttctatgggtctgaaaactgtgaacacaaatcagaactggacaaaaccaaatgtagatggcaggcaccccctccttacctcctgaaccattctggactaactacatcttgccacagctttctgaaatacccaagttcattgcctgaccatgaatagagagagagagattcccagaaagaaagagtgaaggaacaagactttgattaactattgcctgtatctgcgatagttacaacccaagggtgatcaatgtcagtatcactttttcctgcacttctctgggactatttaattccatgttttgaaatgagacttataatcaataactaactagaagtctgccctctaatgactccacagaagtgtggggacatgaggaggctttggccctgtcccctgaagtgccactgagcaatgaacaggctgatttcatagcaagtgaatggttgccaagtgcgtattcagtaacttgcttgagctcagaggcaggacaggggacagctagcagccaagatgggaaaagaacccaggagacccgacttgcagactccccctctaaccaccagactggcactcccttactaaataggaaaagttgtcctcattcagcaactagaagttcaaggaagaaaaataattaagagcacataaatagctggccaggatgcaagctggcaacatttttaactgggctgcaatgcaagagatggaggtggaggggactctgtgcagaactcttgcttcatcaggtctctgaccagtggtgtcaaactgtaatgctatgttagaccagccagaggctgccaacagcaacactatgaaaacgccccattagtcaactgttgaaggaagacaaagaagccttagaaggggataatattctgtctttgaaccaatgggcaagttacaaccttttgtggggaagaggaggtagtcccagaaaatagacacctcatttctttctctgacattgagaaagatcatatatactaactaaagattgtttcaatggttctgattaaatgagtgacttaccacacataacattgtaaagttcaatgttttcaaatggaggcactttagtcttgtacttaaatgttgagccataacctacaaaaacagtcttccaaaagaaaagaaaaacaaaaacagttaagcattgttaggtaggaacccttcctctatttatgaatactgtacaacttcactcacaccaccattacttatcctttcgaagaaccactaaaacacaatttcaattcacagttctgccatcatacctgcatgctgttgaccttgttatcaaatccgtggtctccctggaaaaagcattttcctgatggtttcttataaacatccaaaggtttcctaaattgaaacaatttcatgattagttagaatttctcatgaaattactttgataaaaaggtaatttcagggtacaaagaatatctaagaaggggcttttgaaagtttgcctctattttaattgcattcttcttgtgatgatgaaaagaggatcctatgcatttctccaagtgacttttctttgacagttattgcaggataaatggcgacctgtgaactgaagtcacgatgccctccttggagctcgtgcttacaccaagtagggcacttgtcaaaagtcatgctctgcctgtctaggtgcttcgctagctctgagactgtaagattctcgactctaggaccatgtttgtctggttcacttctatgtacccctccctagggtcagtgtcaagacatagttggcactttaaaaaaatgtgatgtctcacctattatatacccataataatttaaaatttaaaataaaataaatttgcgatgtttaaacaatgaatggagatctatattctataaaaatatttgcatgcaaatttatctatcaatatacaatacaactagagtacaactaagcagccaacttaacagtaatcatgacatatctgacaaaagcatggtctcacctagacaatatctctatttagaaacagaaaacagaaatactgctctctagacatcaagaccatctgatctttccttttgtgacagaagacaccttttgcaaaagtgtcatgtgacccttttccaaaatagctttcatgttaatttaatacaaatatttcctaagtacctatgggtatatagcactgaaagtgctttgggaaaacaaaaaatctaacatacgggtctccacccttggaaaaataagggcttgggataataagacatatgcatacaatacctcaacaatgcaagatgagttaaatttaaaagatgcattgttaaccaacatgcctggttttgggctacactaatttgcccaactgtcatcatctttcacttaacttctactcagctcccatgtttttgccatatgaacctactacctgcgccagtgtgaccccttccaagctgccccatacataaaaggtccttcaggagcacataccgggccaattaatttcagtcacatcccaattaatttaccaggccagtaaattctccatgaggatttcccacaactgttttagaagactccaataattcctgttcttcgtacatctttcttcataatcccacatatctaactctaagtacaccctggaaaattacagcatgatatttatgtatctgtcaaatgtgtctctctaaacatcccatactgatacaagtttctagagttctaagttcttcttagaacttgagtttctaaatattttcttgttatcttctttctcttgcaaactagtacccagctagagtacatgtggcagttgttcaattattgagatagacaaattcacagcacttttcttaagtagaaagttggagcaagagtgagtgggaacagctacttccaggtctgtgtgaaaatggataaatccttaataattaactcattggaagttgttagagcctccagacatgtcctagaccacattcaaaagcaaggaacattctcttcaacattggagagtgttttgtagttcaatagaaggcaaacattgggaatatttaaagcaatgtaaaaagtgcccacaataacagagtttttaacattaacaacattttctaaagtcctctataaatattgctacaagcaaagtctcaacaaccgagatcaaatcagcccaatatactaaggcaagctcccatttatacttttgacttactcaagtagtaagaatagagtttagaatgtaaattcaaaggatgaaagagacacacacacacacacacacacacacacacacacagatgcactgacagactgcaaagagacaccacaatgctgagacccagaacatagagatatattgtctcagcactgatggtttatgtagcccacaaaatctttggaaacagtgagatttccaactgatatttctttcagtgatgactaaggatgataaaatatttccagttgccaaaggggtggttgtggaaatgagaaacagaaatagcccatataccagttaccttgcaacatgccatctgcgttccaccaataaatggatatcctcaattcttctgttgttggcatagtgcaaacgtttgggaaggtgctgtttcaagtaaggcttaaagtgctgatctggttttttacactgaaatagaaatggaaatcagacttcagatggaatgtcttttggaaaaattcttacaaattctctctctagaaagctgaaggagattttaagcctaaccaaaggttaatgagtgaataaatgaaatttatttctattaaataatgtatgctgaaaacaaatagattcaaaagagattaagtaaccttggagatgatatgacaggctatctgaggacagttaggaattttaagatgcattcctggcttgtgagaccatcgctaagagcaattcacactccaaggcctttcccaactccttcaagtcaagcagttgggggtggggtgtcggtgggaggggaggagcacatgggtttaggcttatctgattagatgctcttgtaccactaaggtcgctacccagcatccgggaacaatggagcagagtgggtgggcagttctggttcagggaaagtaaagatttgtttaaccatgaatgaatacttttcagttctaatggaaggatcagatattctccatttgtatcattgccaagaccattagggagcctgcagctgaccacaggccagaagttttgaaagttcttaaggaaacaaatatacaggatggcagggcagtgaggaaagtgttcctcccacccctccccgccgggggaggcacacacaggagggaggctgctccaggggcagaggcctgggcagggcagaggcgggacaactggaaacacttaccgtgagattggcaataatggctttggggtcatctgttcaaagagaggagaaagatttcaaaagaaataacaaccattaccaagagaaatcatttttgcagcaagatactcaattctttctccttccatcccacagaagactatcactttagtgttttgtttgaaagataaataattgtgtaggggtatttaacatttcagtcattgacatgcagctaagcaagtggaacaaatcctatagtaaactgccctcctaggtccagttctgctcttctggagggaattcctccttccatagcaccaggatactgctaggtaaattgcttcttgttttaagttccccctaatggttccccttgagacataatttatttgcagtttgacctcaggaactaaactgggcatttggggcttttaatgtaacttcttatttatctgcagatttttgaaacaagtcttcacccactttaagttgaaacttctaatccattgagttatttttttaaaagggagtttgtttccctatttatatcctgggtgtaattacacaggtagccgcacctctccagccatagacacacacgtgcatgcacctcctttattttcaatagcatcaagtaaaagattttagtcaatactctgaactagctaaaagcaaaattatgtaaatgatggctgtgcataaactgtggacaggattatattatctgaagctccccttttgggcggaatgtggggagaaagaggagattgtaggttgcttggattttgttttgttttcaggaagtttgcttcagtatgttattacagaatcagcagaaaaggaaagtggtgttcagaagagatagcaactatcatgaggcagccctccctggcatctaaataccagtggagcaggccttatctgtatcacgtgctgctgcatccctgggcctgttcagagtagacactcaatatacatttgttaataaatatttgttcatatttgttaaaaatgtatgaataaacttgccttgggatataaatatacagactccaaagtctattttcagaatcttagctctaaagcttgaaatccgaaactaaaatgtgtattccattggccttaattacatctcttactagaaggcaaataagtaataatgtaataataatagcccgaatagatttcatactatgtgcctgtctttctataagagctctgcaggtggccagatacagtgatgcctgtaatcccagcactttgagaggcaggggtgggtggatcacaagttcaggagatcgagaccatcctggctaacatggtgaaatcccgtctctactaaaaatacaaaaaattagccaggcttggtggcatgtgcctgtagtcccagctacttgggaagctgaggcaggagaattgcttgaacccaggaggcagaggttgcagtgagccaagatggagccactgcactccagcctgggcgacagaacaaaactccgcctcaaaaaaaaaaaaaaaaaaaaaaaagagctttgcaggcactttctctctggtcattcacaataaccctaggaggtaaatgctgttcaaatcctcactaagccaatgggttttcagaaggaggaggagttggcactctgacactcaagcaacctgattgagcaagccaggcctcataaatcatattcctcaaagggacgaaataaagtaagttcatggtctttgacaatgaagagaagtaaatagcatgtactcagataagtcccagagaattactaggaatatccaatgcctgagtccatactggggacatcaatccttcaattctgaagaacttagtctttgcaggctaacagtcctcattttgtgtgaagaaagggcagtggttcagctaatctggcttcaaatctcagatctgaaacttactaaccatcatcctcgaagctagttccctcacccctctctgagcctcaatttctactgtctataaaagggatagtgatacttatcacacaatgctattaaaaggattaaataagagtgtatgtgtatgtgtgtgtgtctctatctgaaatagtggtatgactaagacatcatcatcatatccaacctttatatagctttgactatgtgctaagcactgatctaaattatgtaaacacaatctcttgtttaatcttcctaacaatccttaccttgcagatgaggaagcagaggtacagggcgtcacatggtgagtaccgagcagagctgagatatgaacccagacatctgtgcctgtcaccaccccatgctactgtctcccacaaaatgaaaccacattggaaagtgtttttgtaaagtacaaaaatttttatcattgatagttatgaattcatgggccatgggaaggtttttttttctcctccaaaccaacctccccattacatgtactaatgtcagaaatattgttaaaaatagagaaaatcttttttgcatagccctgaagtgcaaatactaaaatcgaggggtgccatagtgactgcatccagtctatgcgagggcagaaaagggaggacacagggacaggaaaggtcatggaggagagagggcagaaacacccacattttgtttatttcacaacatggtctggagctgaccctggaacagttccagttgtgttgactcaggaacataattagggaaaaacttaattttccaaagctgtaaggttggtgtcaatggtttcttattcccaaggctaaaaactctaaagaatttttttttcaaagtgcggcataaccccaataaaactatggacttctcaaaagctaggtagacagcacctaaaaatcttagtccacaaattaagtttgtatcagtggtagatcataacctgaacatgtaaaacataagtgacaagattattcctgtttatttttatttctaatctttcaggacagctgccacttcccaagggcttaatatcttttcctactaggttctaccaatcacttttacaaagagaatggactccattccacaaggctcctaggaacccccacagtccaaatgtggttctgccaacccttacatagaccctctagtttcatctataaaaatgatcagcctgaacttcttattgaaaaaattcttatcttataaacttctgtttatggtcatgaatatgcttcaaactaagtgcaatttccacataataagaataagagcaaatatttatataatgctactatgtgccaggaaccactctaagcaatatgcatagattaatttctacaggtagctgctagcatttatcatccccatttttcagatgaaaaaactgaggcttagagtctaaatgacttatttaaggtcactcagctaagcggtagcagagccagaatttttacccaagtatttcagctttagaaaacaagcccttacctattcctttgtattaccactctaaccacttaatattttaagaatcaacttacatttagcattgttgctaaatttggatcgaattcttcctagagttccaggcactaaagtaatatcatccacattagttaggtaattactcaagaactcagttctatcacatgtgacatcttccattcctatggggagggagaaaaagaatattttcaggcaagactaaaacgaaaatcttaacatagacacgaaagataacatccaggcatctctttagttagtttttagtaacttaatgggaagagccctgacttttgagatttttgtatttgactttaaatggtttaaggcttctctgtataatcttttctctagacttttacttagccatatcatcttgcaagcactagaaggttgaaagtgcattacctcgattacattttaagtcactcagccagaatagcaagacaaaggaagtcaccatgatttaaacaacaacaacaacaaacataactattgacagagtctttatgaaaaagatctattctttaaaaaaaaaaaaaaaaaaaaaccctaggttgcatcaaactcttcccagctgggggtggtataaatggaatatacagttctgtgtctcttttacaaaatgtcattttccaactctctaatatatctcctgtcttgagtacataatcaccagtcctcactgtctccactggtggccttggatgttactgacaaaacaatactggcaacaagagatgagaaagaaaaatgtcagttccaatgaccacccaaactgaaaaacaaaataacactgaaaacaagttgtaaacaatgtaattagtcagaactgaaagctagcaactaaagcaagaaggttctaggtagggaatttttttaaacaacaaatatttctcctccaccccaagatttgttgtgtgtccccatcaaggaaaattcttttattaaaatgcttttatttaaaacattgttgtaaactcaaatcttagcatcatagactatggaggctactagagatcttattgaaatgtatgagatgacctggaacgttttaatatattgctcagtacaattcagtatgtacatattctctaacagggaaaataaccctgttggagaatactcatatatttatatcctgtaaaggatgcccaaaggttttaaaataaggaaatacaacccagagtaccccagatctggtaaaatttaactaatcacctcctaggatcccagatccagaaccttcccttgtttaatacaaattggaatgaaatgcaagaaaaaacacacagcataaggattatatatcttgcactttaacagttaaacccttaggaagaaaaatagagcaatgaagagctactatgttttagtacaatgttagcgtgggaagggaaagtccccaaatacctattaatagagggctgaaagtctttcccatttgttatatttctaggaagtcccttatgccaccccaaatgtgagcaatctcctttacttttgaagtccatcaggcactatgctaagtgctcctcaagcgtcatcagccttcactctgcagactaactttgtggaggggtgttaatgttctcacctgacagatgaggaaactgagacttgccacaaaaggtgtatagtgtcagatagctgttaaatgacacagtgcaatttgaactccactaaaattcattatgactccaaagaccatgccctaaaacactaaaccataccatcttttaagagagaggtgctgtacactttgggaggccaaggcaggcagatcacctgaggccaggacttcgagaccggcctggccaacatggtgaaagcccatgtctactaaaaatacaaaatttagccgggcctggtggcaggtgcctgtaatcccagctactcaggaggctgaggcaggagaatcacttgaacccgggaggtggaggttgcagtgagccaagattgcaccattgcattccatcttgggcgatgagagtgaaactccacctcaaaaaaaaaaaaaaaaaaaaaaaagaagaagaagaagtgctgtagttgtcccaaaccaaatggatctactcatcttggaagcctacacactgacaagccaaggttttaacctatccatgacctttacaatgcctcagcacatatcattgggacccttctacttagatgtctggctccagcatgtgagcaaatgctcttgacacctctgggcaacttaaattgaatcagctgtgacacatgctccaacttctctgacctgtgtgtagctctccactaagccgaatgcatggagcatgacttcgcaaagggttatatctagcccactcaagaggagaaagctaatccctttggcttttttttttttttttttttttttttttctaatttctcatagatcttctaggacattctggaaagaccttcaggaccagagctagggagatttgcctaccattcttaacagaactgccaaagagtcagccaattttcatcctccgaactccactagaagggagaagccccaaattccaatgctactgtttcaatctaatagttccggaatacaggagataccctttagaactcagtctgcatgtctctgagcccccaccccctgcacagctctacagtcatataatgtttatgatgctcttgatctcctcaaagaattgatcataaatttttctacttcataaagtgggatttagaaaaactacttcctataatgcttcttcctctctttaacagtcatctgaattacagcagggccttccggtttggaccttgacttccctcagtggattcggggaaatgatttgacttacacgccacttctttgacaagaatcccatatctctgcttctttatcatatttagatgtattttttaaccatataaactccatgggctcgttttggggatgtggctggcagggataggagattatcacctgatatgtcacattcacagaagaagctattaatgtcacaaggaaactgtctgtgttgctttaaagagagacagatttttgtagaaaggtctttcctgcaaataacagaaatatataagaagtcccagcttttgatcaaaatgaacccagggatctctcaggtcatctcatacttttcaatcatggcctgatttctatccccatcttaaagaaagcggggatgaggttaagaatggagtcttggcttctaagggcaaggattcttttcctcaatatgatcagaaacattatccatctatcctattagcaaagaaaaaacaaagctttaccatggtctccgacaaagatgacgttgacacaccgatgcagttttagttgtttcagtccatccattaattgccccacaattttgtcgatttccctcagaggatttgtcatctaggaaaaagaagcaagttagtccccacagggttttctttctttccctttcagtctctcatagatcttctacccctagaacattttggaaagaaaacttccggcccagaggcagagctttgtctggggagatttgcctgccattcttaatgaaatctggtctaagcacgttatatttgtattcttttgacagaattaaaacctctcctcatccaatccctttaaagattctttgatataaaaatgtcaaaaatattgttaatgaaaattctttaagagagaaaatcgactttctaatatgtgacagcatcctttaaatccaagagttttgagagtaaacagaaagtccctaagtgaaatcacattagattttgaactatggcaagaagatagacgctaagtgaattcaaagctgttctgaggttaaaatcacaacgttgcactggataataaattagaatatcattaatacaatgagatccatcttgttctaagtaatttaactgttggcatctgaaagcaatagattcttaacagaagaacctattctaagaaacaagttattgcttctcactttagttcttttaaagctgattttgagtgaaacaagaatctataagagtcctaacttaaaaagaagtgaaccatgagtttgttctagaaggtttcttctttaacaaaatatgaaaactcaattcttttctgaagaccatttccaaagcctaaaaaacattacccatatctcattttcttacttcaaatggaagtttctaacagcatgaatgtcctcacatactagaggctctccatccccctttcatctttagctgtgcaatggaaagatttttaagaaacatctgatcagacaaagaatagaaagatacagggagtatatttagatgaattttatagcttagctaacaatcacataaatatacccaagatgattaagataagaacagaaaggatgtgaatatcatttttactcggacacataatattatcttccactagcatcttctcagatgaatcaagacctttcctcctgttatttcattgggaaatcaggtgtaaacttttgtttttttcttcatgacgggagtcagtatttcaagtcctatcccaaggaggaagccacagttgaaagtttcagaaagacatgtgcagaataatcggaagggactaacgggtgtggaacaaagtggtatttgcttctgagaaaatcatgctctgctccaagatctctgtctaggtaaagaaataccaaatgaacaatgtgttttgatctttggcaatgacttattttcctttactcagcaggatgactcaggtaaaatccagaacctacttcttagggatcagttcagaggatcacaaataagatactgcctcagaggtattcaaaggttttaggaaaagcaacaaccgataggctcttctgaacatactgggaagagtagacattacttgtggaaattacatacaactctatccgcccattattttctctttctttctgtcttagctatttccttctctataacctacaccttttctgatctctgaaggtacagacccctaatctaagccaacttcctattgagttctaatccacattgtctttgagaatacctccttttaccttgcagggttgttctcaagaaccagggccacaaaccatgtgactgattctgtgaataagtgcactcttaatagtcactccagcctaaatgttaatactagttttagggcaactaactcttaaaaaaaggaaaagacttctttttttcctgtcatgttgagttcaggcagtcttcacatcagtgttaacctctgaagtaccacattcttctggactcaaagccaaggtcaatgcaccagagtttttctaaaacttgctcagccgattttccaaccaaggcactgaaggcaaccttcaactcagacctgcccgccacaaagctttggaacaatagataaacttactttgtcctgacgagtttccgcagcataatgatccatcctatgtatttttcttcttcttttctttggaggagcaactggtctttcctgtctcctcttaggggcaactttcctcttaggtctcttagccggagtaaaaggtgagccataactactctcctgtactggcggatagagatgtctggactcagaagtcgtctgtccctctgagtcagatataaagcttacactttcccatctgggatcagcagagtctcagaataactaaggctccttaagtgagaaaaaattggaatgagggatggatgattagaggaactctatggagagaagcctcctaaattgatgttgatactgttgtcacagcttcttcgctgagaacaagaatccaatttaagaaaatctagtcatgtgggtttcttttggctgatatttatggatgtatgggaaggtggcattagacaagctctgtattccataactcctgcattagggagagactggtctttggttatgaaaagctctccatttataaagaactaactgaaaagtaggctaaatactagccacttggtcatttcaagaggacaatgaggttcatgtaagtgattccaattcagaatctgacagttatctttctgttcacgtcagcaactatgtcaaagcaactgtcaccttcattggcaaggatccagtgaaaaattttaaaaccaaggacggaatgaaacataaataataagtaatcctccttaatcataaacgtactcccacaaatcaggactttcagcaggagagagaactcactgacaattaaggttttcagtacagaggaactctaagttaaagtccttttaaaattaggtaaaatctaaaaagtcatcaaaaagtcatctcttttttgtcttggtatatacagaccaagaaagagtctccttatgctcttgctatcagaaacctgcttttaaggggcgttgcatgctatgggttttgttttgaaaatccagagagcagtgaagttgacacataaactgaagataaccttttgggatttccaaatgctggaggaaaaacaggcccctgatttgctgatggtgcaaaggtgaattaaagcagcaagccttgctgtctacctcactgacttctctcggagggtgggtggggggaatgtcttgagagccattcagatgcaggaaggggcgggaggaggaacaatgttagtgtatccaagaaggggaacatctgccatgcgatttcactgtttccagggcaagccatggcaaaggcacttctgtttctgtctcatcctctctctccaccaaagcaatcaaaagacacagccccaaagactttggttttgtttgtttgttttttaatgctcctagttttaggcaaatctccataagaaaagcagcaaaaggaaaagaggattttccgtttcatggtcactgaatacattctgctagcgctcaagtcggcccatcaaactctatgccatttgcaagagacctcaacattccaaagactccaaagatgagcccttccaattgcagcaggttagaggagcagaagagtagggtttagtcaaactgggttttcatccagtgattatatcgcatgtatttccttcttcaaatgttagaggtacatgaaagctaagttttcactgaccagccatactttagcctgaatttagaaattttagcctgaggttattaagaggatgggaggtagaggtgcaaatttccctgcatttcaggatactttgccatctgaaggtagagactagccagccaaagctctgcctgtaggcccggaagagcagccgaacaaggggtcacagaaaaagcatagaaggtcaaaaagaaaaagattgcgccaataatcaaaagcaagcatatttttgaacattcaccattacactctgaaaccaggagcaatacaccatttcttgaactattaactcaatgtttggtcatctcatttaatagcttttgagaatcattctgaaaaaatgtggactcaaatatttagcaaataaagcacaaatttcaactgaattcatcttattgtagcatatagcattttggtagttaaaatcatttcaatgaaatttcaaatataggttattttcttatatgtaaaagatacgttactgattttaaaataatctttcaactagtatgttataatcttttcatgtataataagtgtaaatgatgatatataggtaggcatataggatacacaggtgtataaaccaattagcctacaatagaagagaatttttgctgacttgctttggtttcatgttttaaaagcataaactattttgtttttcattcagttaaaataagattcctagaaccagatgagaaataattgaaatctgaaaatatcctttgccttatgagaagaaaatgaccaggttatcagattaccattactgaagatatactccaagatacccaattaagagtttatccagtaggcatatgaaaataccctagctgcaagaagtagtaatactgaaaaaaacataacatgaatactttcaactcttaattcaaaggtactataggaaaaatctctgtttatatatttgtgagcaaccctgggcatagaaaaattattatagcaaattaaagcatcctgtatgccgcttcatttattccctactcagtactttcaaaaaaacttatttgtttcttaattcacacaaacatatactttcatgcatttaattgtaactgaactacacatattagaaacccaaagatgtttattgattaagaacatttatcattaagccatataacttttaaggtttgagttatacctcatctgtattattaaaagccaaacttttgccataaagaaaatgttctgtataatttgaacatagttattaactgaccactttgcttatctcctggactgcaggagggttaaatggttccatggaagggagtgtgctctgggagtcaaaagttctgtagtgctatcttcaggttctccccttagcagccaagcgaaagtaccggagtcctacttttaaaaggatggctataccaatccgttttgcctaccccacaggttctttgaggggatgctattacccaagaagtcaaacttttaagtagggaacatggaactgcttaggtgttttgttttgttttgtgaacattttgataaaatgtggttccttttgttccctttaggttaatctcaaagaaagtcaatctaaaaataaaacagccattcttgctttggtgttctttactggcatcatgtatgcagatgtttatctcattttatcatttgtgtttcacaatcatacaagacgggttaaacttcaaagggacagaaaaagagcatctgacttatataacttcagtgatttaagactaagagtggttttacgtagctattagttactagtgcttaaataaatcacctctgaattgatgtcaaagcattcagaaacacttatgactccttggtcacatgctgcaagtattgtcaaaatacttaagtattgtcaaaaaacttaagtattgtcaaaaatacttaaaccaagtatgtttaaccaagtatgtttaaaccaagatatgtttacctgtatttctaattcatctgaaaacaatgaacttaattatagtcagcagtgtcctatgggttactaggctacttaaatatttaaaaatatttaaaaggttagatttgcaaactccatcatattttttactatctatgctgaaaatgtgggaacatttctaaccattcctttcccaccttctgaatttgaaattatactggatactacctcacagattgtcttccacaatgatggctgagtgtttgataaaaatatgtcaccctcagctgggtgtggtggctcacgcctgcaatcccagcactttgggaggccaaggctggtggatcacctgaggtcaggagttagagaccagcctggcacaacatggcggaagcctgtccctactaaaaatacaaaaattagccgagcatggtggtgcacgcctgtaatcccagctactcgggaggctgagacaggagaatcacttgaacctgggaggtggaggttgcagtgagccaagatcacaccactgcactccagcctaggtgacggagcaagactctgtctcaaaaaaaaaaaaaaaaaaaaagtcagcctgctctgctaagcagattcattcagtggtatatttttctcaagaatttatgttactttgggggggtgatgactatgttcatatcttgaatgtggtgacaatttcacagtatatatacctatgccaaaatgtattaaattcaaaagggtccattactataacttatgccaagttgattgtattatatctgccaaggttattggagctgcttagctgatctaccctctctaaactgcctaatcatttcaagggtgctgaaattcatttacaatgttttgcattgcaggtttcatctcaagatttttttccatgcctagcccattgaaggcaaatgccaactcttccgaattattcaccctccaactgacgcccacaaggctagaatacaccccatctcctgttaacatcaagtttaggatatattattatttaaatatcaaatcaatctgaaatgaagctcctgtaacagaaacaggtcgttttaagattttttaaaaaatttttagtcttgtagttatttgactttgcataaaccttgtagatacaaacatccatccagactttatacaattcctgaaataaagtcagtagatcaggtagcccagggccacagattcttctcaggcagatgctaaaccactaacctcagggccgaaagggccatatttgtgtccagagaaatcaggttgctcagaatagaaggcatagaccgaaggcctataagaaaattggaaggttcagaatctctcctaaaccacatgtaacaaaaaatatcacatatttttaaaaaacgcatttaaaaaaaaatgttctcaagtttaatttatcctttaactactattcatgttagcatgaaaaacttttttttttttctgttgcttctgtgaccaccaccccatctgtagtaactgtctggaaccaccttcaggaatcaaaagtcacaaaggaaaacttgaacctgtactcggatccttgaccctcaagataacagagcctggcggtaattcacatgggccgtgcaatctgcagcctgaaacaacaactaactgcattacagagaagcgtctctctttatacttctgcaatccttgggatgctgctggttcatttatcaaagccagaaactcccttcggctctgctgtagtggacagaattaatagctgcagtaatccaagtaattaaatggtcccaataaccaaagtctattgtatccttcttagggaagtaacacttaaggctaagaaccacaaaacttttaattccaaacattggctgtgcttctattccacagtctagtgtttcacgcaattctaaactaagatagaaatgtactgaagaaagaagaaagagagaaataaatacctctcatgatctggcagggtgagccactgcaatatggttaatattctccgctcgtgagggatgacactggagggtaaaagcaagcaaagcatgttgttaggtttcatttccgcaaactcaagcctgaggagtgctcgctcttgcacccaggccaaatgctctctatttaccaccatctgttttcacttcatttgtagtaaaaggccctctttcgaattagcgtttaaactactatttccatttgcaacatattacgttgctcaacctcttccacagaagactacactggaaactctgattcacagtcagaatgaggaacctgtcttgctaatcagaaactccactacaagcagaaaggaccctggtttcagaatcattgtcatttattctgtcgagcctttagctgtggccataaagggatcagtacttacatccccaatccgcctcttgctggcggtgtgacctctcttgaccactcggtctcagtttactcatcggtaagataaagctaacagcaaagaacactgtacagcttggttgtaaggatgaaatgagacaagacaaggaaagggcatgtccagtgcgtaagacacagtaagttctttaaaaacatatttttattaatgatcataatgcgttatcattctgcctctaaataatggtatgactttagaaacactacctaacctgaaactttaagttcctcctctataaaataatgggttagggaaggtattcttgccattttcttccagccctgtaaaaatctaccaagaataggccaggtgcagtggctcatgcctataatcccagcattttgggaagccgaggcaggcagatcacctgaggtcaggagttcgagaccagcctgaccagcatggcaaaaccccgtcactactaaaaatacaaaattagccaggcatggtggcacatgcctgtaatcccagctacttgggaggctgaggcaagagaatcgcttgaatccaggaggcagaggttgcagtgagccaagattacagcattacactacagcctgggcaacaagagtgaaactctgtctcaaaaaaaaaaaaaaaaaagaataggcacatataattaagagactgacaaaaagggtataatcttcatccacaataacttttgtgtttaagtctctttcctctgttgaaatataattaccctaagtctggcactagctttaagggctctaaggcctcacagctaacatgacagtattgcatccccggctgagttacattcagatgctcacaagctgagtgatatctttagtcaggggaaattcacccactctttcccaacagggagcacaaaatgcattttcactccccgatccaagaccaggcattagaggcatgttcatgatgaattcaaactaaagcacaagtttaaatgtggtcaggaaaaattattgtggaacattggtgagccatttaaacttttactctcagtggacatgagcagtgagagagctgggagaaggataaatcctcaagccggggctctcatcaagtggtttctcttcctcccccatcaccatccagctcacagggatttgtcattccccaggcaccctctctttctggaactatcacacaagaccagaaaatcatgtgtgccataaaatgagtccaaatttaaacatattccaatgctattggataaatgcgaccctgatcactatatcctataattgaattagaaataggcagagcaaagccaggttaatcacttaaggaatttaattcttcagctttagaaatcctttgtatctgagcaaaataattgcatactttgaattctttcctgtttaaaaaaaaaaagtgaatgccagagccttttcattatactttatttcactacctgcctaaaagctgctttattttacgtaattggtgttaagccacagaaacgggccctaatgaacccactttcaatactaatggaaaaatacaaactaacagaatctgtgtcaagctcagaatgctcacccctgaatgccctcgttggatggggtacttgaacaatggtagacggggaattaaaagtgccagctatgaggccagagtgcttgggtttgtatcctgactccaacaaatgctggtgataagacttggcaagttatctaaacttttgatgcctctggaaaacgaggacaatataatagtacctatctcataaagttgtagtaaaggtgaaaagagaatacatttagaatagtgaaaagcatttagaatagtgctgggcacatagaaagggtttagaaaaatgttagcttttattgttatatactaaatgtataggtctgcagagatgatatattcattcacaaaatatttgttaagggcatattgggtttaaggcatttgtgtaaacgtaaataaagatattcctaccaaaaagactattatggaggggtcgtcattttcttgggggaaagataagcaagtgataattcttttctgggcaggggctgattgtgtttgtgttgagaataagatgaggacgctggaggtctgagtagccatcctacctctgaccttaggtgcaacatttaacctctctaggccttagtgttctaacctctcaatctctctcttttttttttttttttttttggttgttgttgttgagatggagtcttgctctgtcgcctaggctggagtgcagtgacacaatctcggctcactgcaacctccacctccccggttcaagctattctcctgcctcagcctcccaagtagctgggattaaaggtgcctgccaccacgcctggctaatttttgtatttttagtagagacggggtttcaccatgttggccaggctggttttgaactcctgacctcaagtgatccacccgcttcagcctcccaaagtgctgggattacaggcatgagccaccacacccagcctctaatctcttaaatgaggagttgggcaaggttgtctctgtttcctaggagttctagattatctttatgaaataacctcagagaccaaaaggacatggcccttagccattagcatttcaaatattcaaatacaatgcgcagacagcacaaataaatctgaccaagaaagagcaaaaaaagaaatggggtacatgttgctgtcttcaccaccactgattgatgcagaatttgtcatgagaccaagtatattagaaatggtcaaaaaaaaaaaaaaaagactaagttaagtatttactagtaaaggagagcaaattatcttaagtcatatatagcccttgtctagtcaatgttgaaagagagaatgtgaataagaaaacaaataccatttattagttgttctctgtgtaccaaataccctaataagcattttatgttgttttattttattttattttttattttttgagatggagtcttgctctgtctcccaggctagagtgcagtggcatggtctcggctcactgcaagctccgcctcctgggttcacaccattctcctgcctcagcctcctgagtagctgggattacaggcgcccaccaccacgcctggctaattttttgtatttttagtagagagggggtttcaccgtgttagccaggatgttctccatctcctgaccttgtgatccacccaccttggcctcccaaagtgctgggattacaggcttgagccactgcacccggcctattttattttatttttgagacagggtctcactctgttgcccaggctggggtgcagtggtgccatctcagctcactgcagcctcaaactcctcgggcttggtgatcctcccacctcagtctcccaagtagctgggactataggcacgtgccaccatgcctggctaattttcgtatattttggagagatggggttttgccatgttgcccagcttggtctcaaactcctgtgctcaagcgatccacctgccttccaaagtgctgagactacaggcatgagcccccaggcccggccataagcattttaaatatgttagctcattgcatctttgcaacatcccatgatgaagataccatatatgtgtgtgtgtgtgtgtgtgtgtgtgtgtgtgtgtatttttttttttgagacagagtttcactcttgttgcccaggttggagtgcaatggcatgatctcagctcaccgaaacctctgcctcccaggttcaagccattctcctgcctcagcctcccaggtagctgggattacagacatgtgtccccatgcccagctaattttgtatttttttttttttaggagagacgagggttctccatgttgaataggctggtctcgaactcctgacctcaggtgatctgcccacctcagcccccaaagtgctgggattacaggcgtgagccaccatacccagccgaagatactgtaatttttatttgaagatgaggacatggatttgttgagagattaaatcactagtccaaggtcaccaatctaataagcagccaagctgggatgagaatcaacgtgaacaatcatacataatgggaattactgtctttgaacatgaattggcacaaaagaatggagcatcagccgaagattatttcagaatgaaatactatcatttaaaaggcaagaataattctaggttgcagtacggaaccatgttaaaaagatggccttcaaagtctaagtctatggtttgaatcaggttctaaatttttttaagttttcagaatatacactgtgtagatttccttgacgtatatattctcttaactaactgaaagtgtgatcctatttttttaaagttgtaaaatacttcaaaaaaaaggggaaaaaatgaatccaagtcactttcaggatacagagttaaaataatagtctgagaagcaaatgaaagctacagacatctttggagcatacaaaagccaccttcttataagtgatttcaaatgggtggagaaaattgccattcaaaaccagaacactgggccttttcaatgaggctttgcagcagtttcaggggggcaaaggtggggactcagtattaattatgttgttggctcctctccattctgccaggcaaatatgttacagaacagaagaaaatacttctatgagcgtctatgacagtcaagagttaaagaaatgtcacacataggataacactggtaaatcaacatgctgtttatattaagcagtatcatttccaacctacctacacttacttctcagctcagaaacctctttaaaaaaaaaaaaaagaaagaaagaaatctcttaaagggacagtgtgtgctagattcaaatcaccaaacccaatttcaatttagcccttcaaatctgaaaaagctacttttatttctgattttagagagtatagacagtaccgttctggattaatttgagcctgcagtagctctcagcacactgctattatagaatagtcagatttttgttaggcatacaggcaaatacagaaacagctttaggtggtttaaaaaaaaaaaaaagatggaaagaacatctcagtgggaacaaaatccccgtgaaagttgaaacagattccttttcttactaaggaaccttaaaaatcatcaacatgttgatacttttattaggtaagattcatcttaaggcttatgaacattaactgcttatccccccatcacttctttagggatgggaaggagccccactttcttattagaaaaatcctggagttcagtgggaaaatgaggtgaaaatagaggcttccccttggtctcctgtctggaactttcaatctctagacgactccttcggctccccagaggcctgagaccatctagatatttttaagttgtgaaccaaaataaatataatatgttgtcatatatttatagaaaatgataacgacagccactgccataaatagtctaagagaaatatacatgtcctagatggcaagttaccaaaaacctacaaacaggaatagaaaaatctaaaggacatccggaaggaggagagaccatcttacattctgttgagaggatggggctgggcacggtggctcatgcctgtaatcccagcactttgggagacagaggcgggaggatcacaaggtcaggagtttgagaccagcctcgcaaacgtggtgaaaccctgtctctactaaagatacaaaaaattagccgggagtggtagcaggtgcctgtaattccagccacttgggaggctgaggcaggagaatcacttgaacccgggaggcagaggttgcagtgagccaagattgcgccactgcactctagcctgggtgacagggcaagactccatctcaaaaaaaaaaaaaatagagagagacaggatggaaaaaaggagagctggaggacaaaaagaaggtaggatgaggcacagagggaggatctcaggaaaaaaacacctggaaggttattttgatttagtaaatattcaaaagttctatattttcacatttaactgaaacaaaataaaacttaaattgatgttttagaaattgaatcatagctgtcattttataaacattgacaaaataaaggtaacttacacagaccaaaagaatgttccagctttcaccccttgcttggtggctgtaatccatagctaatgaggaaaatataagcggcttaaaatgtgttctgtgtttttgtcaaagaagaaaaagtttttaaaatacattagatcagatatcttatactctactcacaccccaacataaattttccattatttgcaaccatttattttcacatctggaagtcagaatcattatttccacaaatgttattcaatatattctctgcaaaagctctcaaaagctcctgctatgattctagtgacatattttttaaaatcttattttatctcaaaagcctctctcttctgtacctgtcttttctgatcattgttttgaacaattaacttatgcagcataattctgctcatcaaaggacccaagagtgggccatatgtttcctttactattgaaagcctcaaggaggagtgccccaatttggcatccagatgtcagaattttggaatccagattgtcttgttttagtttaaactagatgaatgagaagggggaaaaaggctaatttttaattttgatttttcctaaatcttttacctagccttttagtaaatgttattttagaggaaagttcctagaataagttaagtgaaccaagcatttcatcaaggtttttaaaatattctttacaccgtgtactattggggaggcataagatataggagtttagaacctgggctctgcaatcagacagtttggattttaagccttgtttctgtcacttaccagccatgtagtcctttggcaagttacttaatatctttgtgtttctgtttcctttacaatgtaaataatcttatctagcatataggattattctaagctttaatgagttaatacatttaaagtccttaaaccagtgtcttaacatctggcaaacactcgataaatttacatatttattgttatgcaataatggaaataaataatccaattattctagtaatattaaaaacagcctaagatggcaagtgtcccactgaacagaagtctatgagaagaaaccccctcacttaaagaaagagaatggaagcaaatacgagagagaattgtggtttgcctaagaccaaaacaaaaatgatctgggaattgtagccagccccttttctggtttcattgtcaccagcctttgagagtatccttaaagagtgacaacttattttttgaggaaatgggtaactgggaggtggagaacatccagaagcttaaccattgtttcaaaatcacctgggatacctgccctgggaaagctcgaaaagggttccagcccccttggagcctctagaaatcctcagccccaaactaacagctactgtagctggcaaatgagggatggggcaggagaacgtacagagcactcttcagtctgtgggttctgagctgctggtgaatttcatcagcctgggagaggtaggggcctcatcctgttcacatggctctgagggaccagaccttcttggccagacttttggttccctgggatgtttggagacataagaatctcagattgttctgagagtccttcactccatttagtccaaagctctttctattttaaagacaaattctggcatcctccaggaaccccagcccaactagggttcagaatgtgtcctggactttcattcattcttgttccagcacctccaccagcaagaagatgagctcaaatgaagtgctggacacactataaaaccatgccagttcccaaagaggccagttccttatattaagggatctattttcatacttattttaattgcttatacacaatcttagcacattccaatatccaaacaacttcctagatgtactgccttgctatttccaagaagattgtactaggcaatacttggcatctatgaaatttaagattaatatggagtttcctaaaggaaaacacacttttaatacaaatttctcaaataatgacctgcactttcaaaaagtatacggtagaatacatgctgatgttggcatcattagggcaacaggaagttctgagagttaatttaactcagtaatccttagggaaaaaagatcactggaagaggtctttacagtgtcaaaaggaaggagcacacagagtgaaaatgacagggtatgttaaaattattatgatggcaaaattaagatcatttgttctttatatttttctgtactttccaacaattttacagtgacaatcaacttacttgtaatcagaaaaaaaaaactaaccaattttaaaaagcagtgtcttagaagcatacagtgtaaactatggaggcaatttaaaggtaaaatttgtatttcttctaaaaacaaaatcaaaaagcagaaaaattctgcctgtttcttggtaaaagtcaggttgaccacattttcaaaaagaaaattgagagcatgatcagaaaagtataaaaactgaacaaaaaagataaaatacttaaaatgaaaagcacattttcccaagggggggaaaaaggcactaaaatattggtccagaagaagaaaagtgaatacaagccgataaggttataaaagagagagagagagagagagagagagaagcttcccggttccttgttaattcagagatataagtgtcaaagtttctctgaatttgaatgcaatataaatttcttcagagggtagtttaaaaaaaaaaatcaggccaggtgtggtggctcacgcctataatcccagcactttgggaggccgaagagggtggatcgcctgaggtcaggagttcgagaccagcctggccaacatggtgaaacccatctctactaaagatacaaaaaaccagccaggagtcgtgataggcacctgtaatcccagctactcaggaggctgaggcaggagaatcgcttaaacccaggaggtacaggttgtagtgagctgagattgcaccactgccctccagcctggatgacagagtgagattctgtctttaaaaaaaaaaaaaaaaatacaactaaaaaaataagcttaagaaaacactgggtttgggctttctccctctaatcccaaaactccctgcattgctttcctttatctggaggcccagctttcaacatttgtgtcctagatgctgctttgtgaaaaggggacaaatgggaatgacattgtatcttgtgatgtgctatttattagaaatcaaaaaggcttcctccacaggaaccaagtaggttaaatatgaaattcaacactttctcaaattcagcatgtagctttgggagaaaaggagaagtttggaaaaagaaaaatattagccaaaaacattttttcaaaaaacataaactactagtgcagtctttctagcagttcctcgaagggaaatcattcctttgcactcgaaagcattgagctaggataaacagaattctaggagaccaggggatcggtggagcacttgcttcagcagatcaatcgctgagaatcagaacaaattaagggtgtgggggttgggggaggcagcagaagagactggggcccaatgcagctggtttccacgtgattagggccagaaggaggtgagtgaggaagctgttggcatgtggccggagctgccgaggctgagatggagtgctgtccttaaggccacctaccctaggggaagcacaggccaaatatgcccccgaaggaaacaaagaacagttccatccgaaacacaatagcggagccaggctctagattgggtcttcgaaacagaaatacaccaagtccctacctgcatgggacccgcagtgtaaagcagacctgtgaataaccaacttcaaaaggaggtggtcaggccgggcgccgtggctcacacctgtaatcccagcactttgggaggccaaggcagacagatcacttgaggtcaggagttcaagaccagactggttgacatagtgaaacgccactctactaaaaatacaaaaaaattttatctgggcatggtggcacacgcctgtaatcccagctacccaggaggtagaggtatgagaatcacttgaacccgggaggcggaggttgctgtgagccgagactgtgccactgccctccagcctgggcgacagagcaaaactctgtctcaaaaaaaataaaaataaaaagagatttccaaatttatgatagtaaaaatataaaagcccaaaggacagtcactttgcttagccagagctggaaatgctgggggaaggaaggcctcctcgggacagacacttcagctgaaatttggaagaaaaataagaggctggtaagcaaaggcaccaggttagcagagctcgccctaactaggtacatttggatacagtacaaagagaaaaaactgcaggtctgcggtagtatatggaaaagaaacaacagaataaagaataggttaaatgttcctgaaaagaaatattgtctctttatcaggacaataaaacagataaaaagaggttagcaatgacttgtactttccatcaagtcaaccccttttggcctggaaagtcacccctattctgtgtcattcttcttctcctgctgtctctgtcttaaacacacatttcttgcattttttcactgcagtcattcactaaaatggcttctgttccaactcattgtaccaccaatactggcagagagcaattctaggtcaagcaacttaagtgataagaatgcatctgctggacagttgcagttgggatcacgcctgtaataccaagactttgagaggctgaggcaggcaccttgcttgagctcagaagttggagacaatcctgggcaacaaggcgaaatgttgtctctacaaaagatacaaaaattagccaggcatggtagtgtgtgcctatagtcccacctgctcaggaggctgaggtgggagtgttgcttgagcccgagaggctgagactgcagtgagccaaaatcatgccactgcactccagcctgggcgactatactaagatgttgtctcattaaatataataataaatttttaaaaaataataatctgcttctcttagaaacaccttactccagaaatgctgacttcaggagacttggatcatgatggggtattaaacttgtttctcaaatctccacatttagtcaactcctaggaatcccattcattcctcccattgctgagaatccagatttaaacagaacagggaacaaccccatggaagtatctttgtattagaaattgcaggaccgtagcagagagaatttccaaagaaaccaacccacttaaggaactccattaaactacgtatgagaaatgcagggtcctacagcaaacgactgcttctagcaatgcatgttgagtattaacaaattaaaagcagactagactttaattgactatatcaaggctaaaaaacaaagattaaattaaattataaaagactaaattaaattattttcggaagacgcctatttagattcaaattttcaaatggccattgtacaattgcctcatcccatctactagagtttatgctaggacaagaagtggcttttattcaccatgtaatctgacccctatgccatttggctaaatgtcttgcatggtttagtccctcagtaaaaataaattgagtttaatttaattatcaatctaagatttgtataaatattttctcttataaatgtataaaaaattataagacttttataaatattttttcactggtgattttaaaacgaagcctctgagaggatggtataaatgcttgtagaatattcattaattttttcttatagtacttttagttgcttatactcttatactttgactaaagtttctttttaattactttttatttataactgacatataataattgtgcatatttatgggatacagtgtgatgtttcaatgcatgtgtacattgtataatgatcaaatcagggtaattaccatatccataactttaaacatttatcatttctttttggtgacaacatttaaaattttccatcttaaatacactacattgttatttgctatagtcaccctactgtataatagaacaccctactgtataatagaatagaacaatactttgtctatatgtttttccaatatgccaaatttcaataaaatgtgtttttaaattgtagttactatgctcctgggaaatcttttttttttttttttttttttgagatggagtctcgcactgtcacccgggctggagtgcaatggtgtgatctcaactcactgcaacctccacctccagcttcaagcaattttcctgcctcagcctcccgagtagctaggattacaggtgcctgccaccacacctggctaattttttgtatctttagtagagatggagtttcactatgttggccaggctggtctcaaactcctgacctcatgatccacccacctcagcctcccaaagtgctgagccatcgcacatgagccaccacgcccggcccctcctaggaattcttatggtggccatcttgcccaagatgacagaaacactagtcagtttcaccacaaatcttggtcagcatgaggagagtactaaacttggtcagatgcgtcaactttgggagttagtgaggaaacaggtaaacagagctgaaacagagacttcacttcattgggcaggttaacagcatttcctctgctctgcttttgcagaagttaatgaatatgtggcctcatcttcttctgagtcatcctaacccaaagcaaaccttatgtcaacacttggtgtaaggtgatccaatttgataaaattactatttatctctaatcctttaaggttcttcaggtaagtttgcttccataatcaaattaatataaaagacccactagtgaaagcttaatggagctctaatttcaatcattttgtgtactcataaaatattcccctatcataaactttgaataatccaccctgtcaacaaatttcactatgatcacaccctaggccattatggacttctgggagtccagcctgaataaagacagcagaatcagagcatctattataaagaaacttatctgcagatgtacaagaagtctttcaatgtttatttttttaataaaaagctcatatttatccttgcatactgatttacctattatgcaatataaatattttgatcacaaatgaccttttcttaaagtgagataccttaagaaaaaatttctatttatagtccttattttgtccataaattgcagcaaaagatttccaggtacaagatcattgaggcatggtggatacatggatgtgtgcagacactgcccaccagtcatgccacggttgagtgcacaaagttctcccagccctcttctctaaccagtgctgcaggaagccactgtctccaatcagaattggcatgagatggaaccacttaccatcttacttctacatgtttctgattgcctgtgtgccctgggttatgttcctaggtgattctgatacttctggccagaagcttgtacacttcagcccagctctgcacattcaacaactgtggctttatgctgctttgctcatgtctgaccaaagcaagttgcgtaaccatacacacggtcacaggaaaaacattaggtagaaagccacctacaaccctttttattttctgcccagtcatttgatctgaagtaaacagggtgatttcttttcaaagtattaatttgctatttcagtatcaaggtaggattctgctttttgtatttaacttcatgatttttaaaaaatagattaaataaaaaaattcatgaatttactgtggatttcagtgagttccctttttttccagcaagtttccctgtttctgttattatagcatcagggctagcatattggggaagtcacagtcatacacttctcttttttattatacgcctaaatctgggaaatcaatgagatctgactatttctttgtcaaaatggttctgaaattcacctcatcaccattgtcaccaccataatcctagggaagacattcatatcatctcacttttataatcatagcctcacaaagatgcatgcatatatacacacagagacacatacacatatgtatacatacatgtatattctatgtgcacatatgtatgtacacatacataaatatataatatatacatatatcagatatataatgcatatatacacatatttcagatatatatataatgcatatatacacatatttcatgtttgtatgtatattaaaagtatcaaaagacagaaacattgccaagtatgaggaaattatacgcattttttccacatctaacaaatttggggatgaaatgtctcaatacatgaacacacaaacacatagacacacaataaatgcaaaacttaccggttgacctccccaccatctatgattaaatttctctcgccctcgcagatgaaaagtggcatcaaatacaggatcatacattgaattgccaacaattccatgtgattctggatatagcccctttttgtaaaagcaaatttattgttaaaataacaatacaataatccacatacattagttctagtatgaattttcttagcatagaaggttttatagcaatacttaatttccaaaattatataagacatgtataaccttcactgtgtatctgtttgagcaaacatgaataatatctatgggacaaattataagccatctgagaaacttaatatgattataagaaatttaacattggggtttttttctgctgtaatttaagaagatgacaataattttcattacaataaattaacctttagtttggaatgtatacatgtgcctccaaagaagcttctatttctaaatacacttttctttctttctaaattctattgctccccgaatcaataaaaatatataaataaattatgttttaaagaaggaagagtggtagaatttgaagtacctgaaaattaaaatatagccctgaagtcaacatttttatttgcaaattcagaaaataaacaatagaccctctggtatttgagagaagtttaatgtatgtgttcaaacagaactgcacctgaaaaaagttttcagctttaaagttggaatgaagttccatcacccacaaagttgtaaaaggcatttgctgtgaacaaatgacccagttaagatggaaaacagaaagattttctttgaacactaaggaacacgttttaaaagtaaagtctctcctttaaagtcattccaggatgaaatcagccctttgaatgtgtatcattcgaaaaaatacttacagtggccaaagtgtataagttaggaaaggttttagttgggtacaccggcctcatgtagggagagtgtgtgccacaagaccctggaaagagaattgcaaatattagaacaagagaaccaacaggaattgcttatagaaaatccattttataaacactcagacatgtgttaccttcacttctgtatttcaaataataaaacacatttaaaactacgtgcccatagatctcaaagcccacagcccactggttagtgtggagatcctagattacagataagaacacagagtatggaaattacttacttagtttttcaatattaggcatgactttgctgcctttcttcatgtatgatgcacggaagccatccacggagaagatgattaatggagggcgaacaaaccttaaacagtaacacattaagcttttagaaacattattaccagagttgccattacgcctagtgattctcaataatgggagcaataatttccaagaaaaaatttcaccgggcgtgatggcttacgcttataatcccagcactttgggagtccgaggcgggctgatcacctgaggtcaggagttcgagaccagcctggcaacatggtgaaacccccatctctactacaaatacaaaaatcagctgcacgtggtggcgggcacctgtaatcccagctacttggaatgctgaggcaggagaatcacttgaacaggggagacagatgttgcagtgagctgagatcgcaccattgcactccagcctgggcgacaagagtgaaactccatctcaaaaaaaatataataaaataaaataaccgaacatattcatttaaccatttaaccacaagccagtcatggttaaatcaagactgcccaacaaaaatactctgtcagtcattcattatctgaattcttgtgtatgagatctgttaaggtacagattaagaagtcatgaaacatttctgttttgtaacaaataacacagtgacctgttattattcattggtagctttttttgagatgagctatcaaggctgccctttctgccttgttcttcatgcctgcgaagatcatttttgttccggggatgtgcttcttgggattctccaaatactccatgagtgtatcctctccccaggagatgcttttgttcttatgggcctctgtataagagaatccaatggcctgatctgtcttccccacaaagagaccatggagatttgacccagccacctgtttgcctcccttttcaacagtgtggaactgggcacacttctgaacaaaaattctcttgcctttttcaacatcacccatatttaattctctctttggttgctggtgctataaaggttcccattcagaagccagatgtcccactgccttggatgccttttttttttttagagggggtctctttcatccaggctggagtccagtggcacaatctgggctcaatgcaacctctgcctcctgggttcaagcgattctcatgcctctgcctcccaagtagctgggattacaagcgctggctaattttttttgtattttttttttagtagaggcggggtgtcaccatgttggccaggctggtctcaaactcctgacctcaaatgatatgcccgcctcagcctcccaagtgctgggattacaggtgtgtaatcaataagtaataattacttattggataacacagttttaaaggttctcaggacttcctctttcattccccactccccgcaaagtaggcaaaacaagaactccaggaaaaacaatactgaaaaaaagtcttagccagaatattcagatgcactttgtaaaatcctcagctgaggtggaatataggggatgttcagaccccaatatgtgcagaggtgattggagaaaactggggggaagaaaactatcaccatttcaagacctaccttcaacctttcgactcatgaattactcctaagtactcataagtttgcctgtataagagaatttcagttccacattgtttctaaatacttctcttttcatttcctgtgagagtttatcagctaatacataaaacttcaaaatagtcataaaatacacttaccctgcagggcattctgcggcctttatttcctcacagtcatcatcaacccaatgcgactctcctataaggaaaaatgggtaaatgtattgttgaatctaattacaaatgccatgccttgaagctcacaattccaggatctgtgtcctgtttgatactttctttatgggatataacaaaaaaaaaaaaaaattctgaaaaaaaaatctagtgtctggtttggcttataaagtacacccatacatgatgggaaagctaagatttaataaccacaagtggtgaggtgtttatttgagccttccgagtctaaatggtttgtagattaaaaaaaccagtggcgtcagtgaacaaaatttcatgtttgtatccctccagaaataaactgtttggtcattagatggaacattcttttctccaccactggagatctcaaagccatagaaagcatggcaaaacttccctttagatgctaaaaaaaaaaaaaaaagtcttagaatctacagagataataagtggaagattacaatagaaagattatttgccaataaatctccatacagcccttgaatttagaaagaaaaaaatgctaaatttcactttttatcttccaccaagatctaagagcataatgtcgagaatagagaacagaaaaggcctcagataaaaacataagctttgctttgaagaaaatacaagttatcaaaaagaatttgccttaaattattttaagacaaacaaaagttacatatcctgaacagaagtaaaatttgtaaccaacacattggagaaattgctcccatgtaaagagaactggaaatcttctctggtcaataagactctaactactggacaatggggtaactattatgctccttaaaataaagaagatttgctacacatatagtaacccagagcacacacgtgggcctcacaaaagtactgaaactagaattttaaaccagtaaaagccaatgcttaatgattcaatgatcaatgattccaagggcttctttttttaaaaaaaattttatttctaacagcctttgtggcttcctggtacacttactgcacaggcaaattaaaaaggaaagggaaataaattctcaaccaattttatgcttcaaaataaaagcataattattgggtaggggaaattaacaatacaataattgtttgggtatggggaaattcttcaaatatattaatataacaccctcttgccacaactaaacaccttacatattgcagaagtaacttgatttttttcctgaaatcttttaatgaacttcttcttaaatgttccacatcagagataatgaaaaggacttgattttgaaatttaaaaagtgacttacaaacaatagataaagattcttggatcttcccatcaacttctataagtgggttgcacggcaacttaaacccattaaagagaataactgcatcttttatattttctgtagtccattaactattgttaattgttggaataaaagcatcatattctacaatcaaccagacaaagccaacactcatgcatatatggctttggggtataacaggaaatgctggccccctcatcccctttaccagcaagtacccccatccctgggcagttgccaatgccttggtgaacagtgtacatccaatagataaaaaagccctggttccttgcctcaagagtagtgacctggatttacttttcagagcaagcaatagagggaggcgaggctaactgagagcatgtcctcacttgtctctccacactcctccttccctatcctgcttccctttcctccgacatggttttcctgcagtatatccgtttcctcaataaactgcatgtaccgaattcctgtctcaggatctgcttctagaaaacttgacctaaaaccaagataggaaatttagaaatctcttcattattatgtttctgtctaattaagaaattctggtttcttcccttgttacttcagatcagtgaaatacagagtagcaaaactaatgaagaagcatgagaaattaaaaaggacaattcattccttcctcccaaactcatatccagtgtggtctattcctagcatccaggatctcctggagcacctccagtttttattcttttaaagctcaggccaatccaaagaaacacgtacctttgcaaaccacttggtaattggtacagcagtctcccctggccaagcagtcctctgagcagtgacaggcattttcttcatttctgacttctccacatctgtccttagtacactcccagccacgggctaaaatcatcccaataaaacattttcactgctgcacactaaccaaatgaaagaagccacaattgcttacaggatttccaatgaagaaagctaaaatctcacatcatttactctgcttgtgaaatttgagttggcttgaggcccagaggacatttggagaatttacagataagatgaatttctaagttttcaaatcagagaacaacatcaaaatgcaattgggttcctttggaaaaatggggccctgaaaggcaagcaagtatccctacgattctcgaattgtcctaaaggacccaacaaatttatgacatcaaaggtttatgatagggctatctactgttgtagggacagcctctatagcttggctcttttaatttctgaagtgggtgtgcttagctttatttttattttatttatttatttatttttgacagagtcttgctctcttgcccactctggagtgctgtggcgcaatctcggctcactgtaacctccgcctccctggttcaagcgattatcccgcctcagcctcctgagtagctgggattacaaacatatgccatcacgtctggctaatttttgtatttttagtagagacggggtttcaccatggtggccaggctggtctcaaactcctgacctcaggtgatcctcccaccttggcctcccaatgtgctgggattacaggcatgagccacagcacctagcctaaagtagctgtgcttagcgttaatcagtgtgattcaaacacaaataacaggacaactacatggtttctatctgcacctggaggttaaagtcctaaataggatgtgaagagtataaagggggcattacaatgtttgctcaagattctaaccactgacccattgtggtcctacctacaatgacaggtcagagttcctactttcaagccaagtaaatgggttacagatttccctctgaacatacctgattgacagctcactgcttaattcttacatttcagaaaaacaacctttccattttaaaaggagtgctgtgttttttgactttttcatctgctagagtgtaagcgccatggcaggaaaagtgacacctctctcttcgctcttctatttccagtggcagactgtaagcctgggagactgcgcctggcacatgctaggtgttcaatcaatatgtattaaattgaattggaaatgaccatggagataaaatataactctttaaattcagaactactctattgagaactttcatagttaactcatttactcattgactcttataccatgttttccgtgttctcggtgccaggatgtcataaagaacaggagagactaggtctgtcttcatggagcttacattccaattggaaaagacagatcataggcaagtaaatcaataagcaagatcatttcagcttatgccaaatgttgtgaaggaagtaacaggtggcattgatagagaaagatagggtgaaataggtgctactccaggaagtagaatggtcaagaaaggtgtcactgagctaaaatacatatgaacacttcaggtctttatctcttaaaatatgtgataagtggaaagaaatgatttttaaagcaatcctgcctcttagtaatattctaccaagagaaacaactattgttaggtgaatacattaataaagagatattacgggccaggctcagtggctcatgtctgtaatcccagcactttgggaggccgaggcaggtggatcgtgaggtcaggagttcgagaccagcctggccaacatggtgaaaccccgtctctactaaagatacaaaaaattagccgggcatggtggtgcatgcctgtaatcccagctactcaggaggctgaggcaggagaatcgcttgaacccaggaggcagaggttgcagtgagccaagatcatgccattgcactccagcatgggtgacaggaggagactccatctaaaaagattaaaaaagagagagagatattagttgtttggcataactgctacccctgccccttttggtaaatcattagccagaaaaccatgcaattactatttaatttttattcttttagaattacctttgcatcctgattctgctgtctgatattttttgttgttttgttttgtttttttgagacagagtctcactctgtcgcctgggctagagtgcagtggcataatctcagctcactgcaacctctacctttcaggttcaagtgattctcctgactcagcttcccaagaaactgggattacaggtgcctccccccatgcctgggtaatttttgtatttttagtagagatgggatttcatcatgctggccaggctggtctcgaactcctgacttcaagtgatctgcctccctcagcctcccaaagtgctgagattacaggcatgagccactatgcccagccattctaattttttaatatcccgtttccattcctatctcttctcgaggagattaagtgcttagaattgcttttcccatgacctgctcttcccaatgatgagcaatcttctaaggttgctttgactctagatattgtggggttttttcaattcaaggtgattctatccaccaataaacttttattccactcctaattccataagaaaatcacatctacattacttacaaaagaatatcattattaataagctatgtttattgaggaactattgtctttatgtacaaatgaaatataaaataaatccagagtttaaagtgaactatacacaaaggacaagtcagtcatctgtgtaattttcaaagcaaacatgggaataaacataaaaaatatttaaccttattggaaaataaggaggaggtcacctaccagattattttaaaaatatttttaaaaataagagtattcaatgctgaaaaggaagtgatgaaaggtccttgtgtcctttagtagaaacataaactttcagaagtataatttagtaatgtatatttaaatttaaaaaaaatgcacatatactttgaccccaaaatcccacttccaaaaatttatcttaaggagaataggcaaaagtatgaatatgcatcaattatattcattgatacatcattcataatagtaaaactcagggaaatattcatttaattactcaatgaattaggttgcaacagttcaatggaatattacatagccattcaaaaggacgatttgtataaagatttattaatacagatactttcgcacacatgcatatatatacacacagttggaagagtatacatgcacacatagatacatactgaaaacacacacacacagagttatcaaagtttcgctgaaacattgtggttgtttctcggcagtgctccctcaacaaaggagaatctcagagccttttgtttttctattcatccttttattattatttgatatttgattccttcacattcaggatatgttatctttgtacacagggaaatggactataagatattatatcccatccttaataaattgaggaacaaaggcatgaactacattcaaaagagagctaagctagagtcagggattcattacattttgcaaagaattctaagaccaggaatccagaagtttgatatgacatgccacagacaagatattcaaggtaaggaggaaacataaaacattagtaaattcctcagtgccaagcaaacacagattgctggcttgaaataatgttttagagccaaaaaaactctgctggaacatctgttccatctatacattcagtttacaatagtctcagcaatttagtttgcagatccacaattaaaagaaactgggagaagttccaaaggaaagcaacccccaaaaaagtggttaaatggttggaaaatgtgttctgcaaaaaacagcctaatgaagctgttcttattgcagggacgcaggaggaaaacaaatcagaactagtaaggaagtttatgttggatttcatataaatcaagagctaccacttaggcaaaacacagtaataactgtttctaatgataaaatttgaaagatcaaactaatagcaatgatagtaagagttaggtctttgaaagaattgtctaagcataaaagtccaaaaacaagaaataacctgccaaggaaaccatggaaactgcttctggtgatgtcaagaacagcattgacggttgtctttctcagatagtttgtgtatggtgttgtccagaagcatggtggatagcttacaagatatctcaaaaatcctatctgaaatattgtgctttgaaaacagagtaggtgggatggcagaagtccccagaggtgtttttctcaactcatgtgcattcatacagaagcctgtacatcctagtaactgttccagcacaaaagaaatgtaaagaaagtcacaaaaagtgtggaggaagattttagagctacccagagcgtgagactccaaacagaattccataacaattttccatttgcagacggcagggaatgacaggcacactaacagttactgtacgataagatgaagtgaaacaaatgctagaagctgggaaagcaagaaaaaaaatttttttaaagaatgtacacaattaggccaggcacagtggctcactcctataatcctagcactttgggaggctgaggcgggaagatggcttgaagccaggagttcaagaccaacctgaccaacacagtgagatgctatctcttaataaataaataagtaataaaaaagaacatacacaattttagcccacaagccctagcagtgaatgtgggaattgacagaaagatatagaaaggatgaaggtgaagaaacaaaaacaaaaacaaaaaacatttgcaaaaccagcacatcatgactgcagctgcaaagaacctttctctgctggaacctatgtggaaacaatggtcattgacatagggtatgctcttcaaagaaccaataatcattcaacaaacaaaactagaatccacagtttggatagaccaaagcagggtggccactccaggatgcatacaatagcaggcagtctttaagccatctacttgaaggtagagaggactcataagttacgtacctgtcttcaaacacagctcatcaaagtcatggcagcaactggtatagctcttacacaagttgtcacagcgacaatcaggaggtccagcctcttgaagttcaaagcacctgcccttgcaagatccggagatgttggtccagggggagtctgatagcactgcaaagaacaagaggcaaaaacaatggactggagagtggtcatgtcaccatggaaaggtggcactgggaagctgtgcggtgtgatgctgcagtggactctggaggagaacactggctccattacttactacccatgtactctgggcaggttgcccaacttccttgttctacgatttcctcatctgtaaagtgggggactcataaaagtaactctatgttgaaaagagaattaaatgaatcaatccatgtaaaacacttagccgcatgtcagacatatagaaagagtaacaagtgttggtgatttgttcaattactatttataattattattactgcaaatctgtgatgattagtgcccctgtgggtgctaacgatgaccacagagaacagtaccttgatctatatccttagaaacaagagagcatgtccctatttaaaaatccaaaactttttacaaggaaaattcagctcaaatgttccaagaacagaacgaatatatgagattggaatagaagacttttacagtttcagctagtgttttacaaatacaagctctataatctgggcttctcaaaaaactcctccatcaatattttcacatgatataggtgtatatcagaaatcaaaagaatcaactaaaatttggggaaaaaaagaattcagtgagatcaaaattccacaaatttgtaatatgcacacaatatagtttcaaaattaaacagaagtttcattctcaatagggcctaaatgataaaatagctaggtattttatttggtataaatttaatcatatgtatgtagaaccaacatacatgagaaaagtctaccaaaaaaaaaatttttaagatctaattaaggtgggggcaaggtgcctcatacctgtaatcccagcactttgggaggccgaggtcggtggatcatctgaggtcaggagttcgagaccagcctggccaacacagtaaaacccagtctctactaaaaatacaaaaattagcccagcgtggtggcaggtgcctgtaatatcagctactcgggaggctgaggcaggagaattgcccgaacctgggaggcagaggttgcagtgagcagagatcgcactattgcactccagcctgggtaacagagtgaaactccgtcttaaaaatatatatatatatatatatatatgatctaattaaaatgaaagacataccaccttaaaggtaaaaatatcaatattataaaaatattaattcttcctaaacaaaccagaagactcagtgcaatcacagccaaaaatactgagagttcatgaaacttgaaaaaattttaaacacttatttaaaaataaaatattttaaaatagaaaacctctgaaaaggaaaagtaatttgataaagactagatagcaaagtatattctgaagttaaataatcaaagtagtctgatactagaaaataagtagattaatgttgtggatgggagccaatcagtaagtagggactataaataattaagttagggtctcatctcaatatacaaaataatttctgctaaatggaaaatataaacagcctcataactgtttccaggaattaaaatttttgtaaagtagaatataatttagaaagacctatcaacatgtttaaatgcttataaatgtttcacccagaaattctattactagaaatttaccatttacacatatttgcaaaagtttgccaagctacatgtacaaaaaatgtccattgttcattgcagtccttttattacaggtaaagagatcctgaaatcaaccaaagttgtttttcccgtcaagaaagaaagaatcgctatatccataagtggactattgcaccgtaagaggactattgcacactccttaaaaagaatgagtcagatcggtgtaggctaatatggaaagatctacaaaatatataaataagttgtttaaagaataaatacaggatagagtgttatatattagactttgtgtttaaaaatagagataaacagggcaataaggatagaaatgaagatagaaataaaaacagagccaaaactagagacgagtgagagacagggtagggcagaaggagggagaaaatgtccaagtttgcatcacgtttttaaaatgcaggtgtgaacaaactttttccttctgtaagaaacaggttatggaattacatttagggaaaatgagaaagaaagaggaagaagatttttaccttcctgatgtttgaaatttctaacattctacaaattcacaggtagttgcctggtctttttgtttgcttacttactttctctttccttctctctcattatatataaataccatacaatatatgtgcgtgtgggtatgtatatttatgtacaaaatatatactgtataatatatgtctgtgtgggtatgtatacatatgcacaaaatatatgtcatatatgtatgtgtgggtatgtgtatatgtacaaaatatataccgtataatagatgtgtgtgtgggtatgtatatatatgtacaaaatatataccatataatatatgtgtgtgtgggtatgtgtatatatgtataaaatataccatatatgtaaatatcctaacaaatattattgacatgcgatttataattttattttcttatttacatgcttatgaatttttcattttttataattcatgttttacttttaaaatcaagaaaaagcaagaagcaggagaagaacagatgttaaatgtcacttctaggttcacccaagccatttatctgaacattctgctcatcccttagtcctttgtcctcgttaaagtcttaaagtcagagtcatccaatcccagcctttatggcatcagatcagttcaactaaagcaaacagatttaccagatcatgagatgtgaaacacttttgcatggttgctcctaggattttgaaagacatacaaaccgtacgagttcagtttagaaaataatattcatttccaatgcagtggtccataaagcacatttttctattgtctttgaccaacctatcaacagtgcatgctgaaccataagaaaccatggaggcaggaggggttgagaagtaaaacaaaaaaaaaattacaaaacagaaaaaaatagagaaagtcctacagtaaaaataaatataaggaaagtacttacaattgaatattccttaaggatactgcttagatagactcatttcaacagcgttctagtaaattttcagtagaattcattcccacgagctgcttaaataaataagcttagctatgctgatagctgagatacttcaaagagatctaaaggcaatttgtttacagatgtgcggtgttcctgcatgcatttgaaattgtcctgcaaccacgcgccttgctttccttcatcatcatttcttccctatttctttcttttttttttttgagacggagttttgctcttgttgcccaggctggagtgcaatggtgtgatctcggctcactgcaacctctgcctcccgggttcaaagggttctcctgcctcagcctcctgagtagctgggattagaggcacccaccaccatgtccagcaattttcgtatttttagtagagacagggtttcaccatgttggtcaggctggtctttaactcctgacctcaggtgatccacctactttggccttccaaagtgctggggttacaggcttaagccaccacatccggcctatttctttctttactttcagagtatctgtgtgaatttttagccacatttaatctttcttcactcattcacctgatttttactattttcttacaacattaatcattctctaaatttgtcctttgctttgtttttggaaaataattgaatctcacttaatagtcggtccctatcagttacagttcttgccaaacctaaagacaagcaaaactaaagacaactttgttagagttagccttacactcataatgccaagatgtatctcaaaagaagtactgtacttaagatcaagttattgacagcttcaaattagggtatactcctggggctgggtggattaggatatacctatgtcaaaattcattctcggatgatttgaattcagctgagaatgacaggaaagaaaaagggaaggtagtttgagccatatagaacctcttataaaccaataacccaaataaatttgagctgctatctctttttttttttcttttttttcttttctgagacggagttttgctcttgtcacccaggctggagtgtaatggtgcgatctcggctcactgcaacccccgcctcctgggttcaagtgattctcctgcctcagcctcccgagtagctggaataacaggcacccgccactatgcccggctaattttttgtatttttggtagagacggggtttcaccatgttggtcaggctggtcttgaactcctgacctcgtgatccgcctgccttggcctcccaaagtgctgggattacaggtgtgagccactgcgcccagccatgctgctatcttttttttttttttttttttttttttttttgagacggagtcttgctctgtcacccaggctggagtgcagtggcgcaatcttggctcactacaagctctgtcttctgggttcacaccattctcctgcctcagcctcctgagtagctgggactacaggtgcccaccaccatgcccggctaattttttgtatttttagtacagaccgggtttcaccgtgttagccaggatggtctcgatctcctgacattgtgatccgcccaccttggccttccaaagtgctgggattacaggcgtgagccaccacgcccagtctatctcttttaaataaaatacagtgagtgtatgatgacactcagtaatgccacacactcctgtgtgcaatggaaaagaccatcttgatgagtgtacaaaaaaaataaacaaaatgattaaattaacaaataaataaaatagaacaatagagtggaatattcactctgcctttccagggtctattccgtcccagccatcttctttcacgacaagctctagtcccaactgttttcctaggagttctgcaatccaccttcatattctttttttaatcattttttatggatgaataatagaggtacatagttttggggtgataatacattcatgtagttgataaaaatcaagtcagtatacttggagtcttcacgttccctgtccttctccctacacccagcctaagatgtttaaaatcaagaaaaatcaagaagcagaaggagaacgatgttaaatgtcatttccaggctcgcccaagccatttatctgaacattctgctcatccctcagtcctttgttcctgcatgcatttgaagtttttaggacttctctctttattgtacctgacgtaatgtcaaatagggaaagattatccgatttgttagaagtctgagttttaaaatctgttgtcttcctttacttgacctaaatcaagagaacattgatgtaagcacttcagatgtgtaacttattgagaggcgggatgaaaactgaaacatcaacaaacttgtggtatcccaaatttttcatcattactgagatggccgtaacagcgcagaaaacaactaaaacaaacaaaaagtactctccaaatgtatcaaggcagaaatatgtgataagtatgatggaggcttgaaatttcttatgaggcatttgctaatacctttatgagattcaaattctattgccgccttttaaaatacatattcaaatgatgttattttacttcaaagatgcaagtcagttccagaatcttgaaaaacaaatgttcatagctttatatagtgttcttttaaaaaatagaaacctcaaattttaaaatacacataggtacatatatgacatgtataacaacaatgcaatgcatttcttatttttcacagaagcataatttcatgatttaaagaaacaccaatgtaaaacatacgttatttcattcaaattcataattctgacagaaacaggtacaattacttttacttaagtcaactttatgtctaaaatattccatcttacaatatgtatagagaggtagggttgtagaattctagtgccggccgggcacggtggctcacgcctgtaatcccaagactttgggaggccaaggtgggccgatcacctgaggttgggagttcaagaccagcctgacaaacatggagaaaacccatctttactaaaaatacaaaattagccaggcatgggggtgcacacctgtaatctcagctagggctgaggcaagagaattgcttgaggtggaggttgcagtgagccgagatcatgccattgcactccagcctgggcaacaagagcgaaactccatctcaaaaaacaacaacaacaaaagaattctagtgccatctgttccataagatacaacaaaactattgatgatttaaatttttggaaggagcctaaccgatgacaaaagttatggccaaaacattacttgatctaaggctcccaatcatatttccctctaaatgtcccccgtaaagatgcaaatactcaaatctggatgatggccaatagaagaggcagtatttaagtttggaaacatttagcttagcctaaagggggaaggttcttctaagctttgtctgctcctgtttatgatactgctctctatctgttcctcccattctccttggttcttagcccaggtatttcctgaaagtgagagcaaaaccttaaaatgtgttaccagctgtggttataccagctccttttctcaagagcgttaaaacaggacaagttcccttatgtctgctgccctgtttgaagcataacccacagggcaaggcagaggacagtgtgcgtggcattcaagatgctgcccagctctagagttaatactgtattatgcctcttctggagtatatggttcgttctttctggtcatacttttttcgtattgaatttgccattttttattgatgcttctgacctcattttttagtaaatagaacttacacacaggtctacatgtcagtatctttgcttcctaaatacataactttttataaatatccattactgcaacatcactgttctctcctcttcacagctgctaggccagatttcataaacttttttttttttaataaagaggtccacctgggaagtttttaaacacctgtgctttcaaaacatttataaacacaatggtctgacctgcctcggtgactcatgcctgtaatcctagcaatttgggaggctgaggcgagtggatcacctgaggtcaggagttcgagagcagcctggctaacatggtgaaacctcatctctactaaaaatacaaaaattagcctggcgcggtggtgggcgcctgtaatctcagctactcgggaggctgaggcaggagaatcacttgaacctgggaggtggaggttgcagttagctgagatcacgccactgcactccagtctgggtgacagaatgagactctctctcaaaaaataaatacatacatacatacatacatacatacatacatacatacacacaatgtcctcatatagagctcacaaactagaaggaaaaaaaaagatttctacgtaattgaagttaaaagttaaaaactttacttcaacatctaaaccacttaaatagaatttaatggccatcagtagcataaatctgaatgatttgcacatctgctaccaaacaataaaatgttgtcatttaaaattaaaggtattgttaactcaataaggtataagtttaaacactggccttcaaacctaattgaagattaattaaatgaattatcatatacttaacaccttatagttctcatcagccttaaaggcattttcaaaaactttttcagataaataaaagcgactttatccccattttcctggttggaaaattagatctctaggccttgtatgagttagccaaggcctggataaaattttagatcatctcactgtaactacagtatttttttcattaatgaaaggtttttcaaacttttgtacatagttttcaaattttagaagttcttttcaaaatataattttggggaagatttgctgattttattgattcaaaaatctaggctgaagttcatggaagactgagatttctgagtatgtaaactagatagaggagtctctacagttttcagatagatgaaaaatcactacactacagccccatttaacaaagaactgaaaaatctgtaccctccttagcttccagttcagataatttcattccattgactcaaactccccaatttctacctgaaatttcacataaagccccatgacaggataatcctaatgaccgagttttgctcacagagcaaatggctgatctacgtcccctttacagtttcctgcattctcccatgccaacatttaaatagcttttcattgcagagcaaaatttctaaaattatcaaatgaacataaaccttctcacttctagttccattttctgatttccctatgattctcaaagaaaagctttatccataaagttgttagtgacagtctacatttcatatgaacctatgaatttcattcacatacttttcaactttcctttcaagccactaaaaacaatgatgaattaaactgagcttttaagtctctgttagccagctattcacaagctcacaaatttccttttgtcttttaagaattaaattacttacatatcaaagaggatattctatttccacctggagacagtttctaaatcacaagtttcaataaaatagactcctgcataacaccacaaacatacacactgcaagtgcacatgagtgcacagacacctgtagacatataaagtctcttgcagtcttaaaggcaaatcaagtgggccacatcagacatatgagaaaaagatgtcaaactaaatcacagttatggcttatattttcttagaaaatttattccacccatctcaccgtctcattaacctgaatgcccattgtatttacccaacagaattataagtagcttttctcatttcatatctcctaataaatctataaatcttttatgacctggtataaaaaatcctgttcagccattatttcctacgctaacaataaatccaggtaacaagtgtgttagttaattaattatgacagtctgtttgcactgccacaaccttgaaactaacaccccagtccatagtacagcagcgagggcatccatgtgtacagaacattctcagctattgttgaggactctgagaagctatggttactaaacaactgcatgcttttgaatggtggatctcactctgatcaatccgaagctagccatatatcaataccctttgtgttccttctatttgttgcacccttggagcactgagcttcccaggatttctttggcgcctaaaaatgttgttggaaataggcatggctgcctcctccccacctagtgtcttattcttacaggcttataaaattcacccagtattttctgatgggaaggcttttctaatggtcagaataaccagtcacatgtgtcaatcgagagagatcctttctaagcatatgcagcatttaaacgcataaagatatttccactgtctacaggatgcttttacctagtttactaagtacatccttgatttttattcaggagaaatcaaccacagttcctaaaaagcacataagctacatcaaaagaaaaattattcaggcatatccaaaccataaaattcagagttaggttgcattgtattctaagactaagcttcacgtggttagaagtttaataaattattttagatgatatcataaaggcctaaaataaccaacgacttaattaaataattcaaggagcaaattcgtgtagcccacttaagaccatttaggtttataaattataatatagaccatactacttttctagaagtggcatttattcattagttcatatagctattcttataacatggaaataatttactatacacaaaatattttcaaagactaataaatccaatctatacttttcaagttttccagtagtgagcacagaaattcaagaggcaatgaaacagaataattcctgggattttttttttttaatccagaaagaaaagtagaaatcatctaagtctgctcctcattgtacagctaaggaaacagacttcacaagtgacttgcccaacaccacacagcaagttacaggactccagggtaccagcctaggattttaatgactgttttccaaaagaagtcacctttaaaaataatgagtgactcaattttacattcattaaggaaacagcatttaattctttcaatctcagttttagccagagtaatatattaagaggaaacagaaaaaaaaagttccctttagtgttcattgaaaagaaccagcagttggctctcaagttgctagctttcccacatgaccatgctaaggatctgattcccctgtctgttcagtcacagtcagtgttaatgggagtgaaaaagaggcctttgaagagagcatttgctgcaaataaaaacagcattctctagctcagtgatccactgtcctctgcctccccaacagaagacgactcattttgtccatttggctccctggggctgcaagttttgtgatctattttctcactcttaaccccgccacaccccacttcaattcactaattcacttctaatattattctttcaacctactggcatgattcaaaagtaacttaattgatgtaaggaagatttagtattccatcaatgtatgtgtcctaacccggttgataataaaatttcaagctggctaaacagaggcaagtgatggtctttcataacaatcagatcaagacatacagagaaacacaaaattcacaggaagacagacaaacatgctggaatgtcaggaaaagtccagaaaatattgttccctagagtgcccattacttaaaatgtaattttttatttctaaaaccatcagcagctccaatttccaggaaattaaccaactcattgcttaagacctggtcagttaagccccctctgtctgcacaaggagctcctttataagaacactgtatgggaacactacttatggtgtagtgtattgtaaaaagaaactctttcactttggttctattatttaagtcaaggtacactattaaaacttacctttcctttgccataaggacacacaatgaggacaaatcaatcctgaaaactctttaaacacctcctctcttttatgtttttccaattttaagtaaatcttaaagtcctaaatttctgaagtttcataaagatagctcactgccttttttacttccattcctttttcctacatcagaactttctagtggcaaatactacatcctatatcatgtgacagcaaatcagatttgggtagctccaatattaaaccaacacctgttctcaccacttctactttagccttgtctgtgaacaagagttttaattgtatcctaacatttacaaatttgagtacaaaaatggaaatagccagttatgaaacaatcataaatgttctctaatgaaaaccacactctcccacctgaattatacacataggtggttttacccagagaaatttaggactaacttagttatactgcaagattgtattaaaaataaatattttaataagcttacattgattaccccgtatgtaatatttttaaaaaattgaaaatgcaaatagttttgacacttacctgtaggaggaccttcctcccatccttctgctctcttaattcgatgtgcagtgaatcctaagcagatattgactccaacggcaaaagtgaacagggatattatctaagagaataaagagaccaagttgtcaaatacagctggagaagactaaatcaaattacacaaaggtgattcaaatggcttcaatatcaacacccaatcctaccacttccaaaatgcataataaggtgctatcttaatttgcacaacaaaaaggaaaatgccaatcagtcactgattctgaagatcaagcatgtcccccgtcattcctccgttctcccacctgacacgactggaacgagctcctccttgccatgtcgaggattcttggaaagccttttgcagcgtgttctctttgccttcacggagtgcactgctttgaggctctgggtttagtctatt

SEQ ID NO: 1365 - DNA, 81788 bp, Homo sapiens; identical to SEQ ID NO: 1363

SEQ ID NO: 1366 - DNA, 35933 bp, Homo sapiens
aaaaccagaaaaaactgaatgtgtgatttattatgtttaagattggtttataaggcttaaatatatctgtcatagttaacagttaacagcaaataaaggcaactttacaaaatcagtgtttccatacagtacaggactaaatgtggcaactgtgcattggaaaattaatatttcctcaatgcaaatatcaaatctgcagcaccatttagaagcttccactaaaaactcaagctgcagtatttattacaagctctactcagaacacaaggctacctaaatcaagcattagagaaaaacagtggagtcattcaggcataatatgtcagatttggtacaggattaaaatactaacatttttaatgtcctggtttcaaattaataaatacaaaaacaatataaaaatatacaaccagttgataagactgtactgcagatgctcagaaagttaaatctcgctctcatatgtatgcaggtatgtcttgagtgtcaggatttctgggtagctgcggctggtctttcggaagaagtccaggctggtgagatgttcaatgtcacgcaccctagctgtgtgcatcttcatgagttcttctacccattttgattcgtcctctgagctctgcaatggaaacagaacaaaatcagaatcagaattttccagaggagtttctccaaatggtcagtttactccaagtccacaaatgacctctgtgcactcttgcacacagagccaacgcatgttgatccttcctggcctccctgccactctaccgcattcctatgggtaatgtgccacaaatacctgcccttggctgtaaacattttcaacagcaattaactgtaccaaataaacgagacatgtggtgtcagagggcatttgactcaataggttctcagaacataaatcaaaattaggaaaaccaaaggccctagagaattcagtaatttgtttcttttccaagctgtcaaattgcaatattgagcacagagtacaagtaacttggaatatgcttctgcttcccaaggaaagtgaagaacttaagcctaatgcacgaaatgatgtgtgtgcattcctagtttttcaaaagaaactgctgcatcaaccacgtcatctactagaatgcataaattgctatttgaaaaatgaggtcaactcgaaaccactcagttgacacatctggcactctagggcccaacaggccagagttggaaatgaggctgtactacttcttggctatgagaccttggtcaagctacttgacttttgaggcctcagtttcttccttggttcacaaggataataatgcttacttctgcagctccctgggaggttagggaggagaggagggaagaagcggggggaaaggtaaagcaaggaaacacggaaaaaagaaagtgaatctctgcctcagctgcttgccaaaaattgccccactgacacaagttgcagatgaaagacattcagatgtcctgcatcaaacaacttatttcatgtctaacttgaaactaaaaggtaattcaggggaagcagttctttgcatctcaaaaatagcttctttcatttttgtgggaagttgagggaaagagtgagatctgagagccctgtgaatatggagcagtgtctactttcattagtagacattgagcaggacctttgcaagtaattccattcacaaatgcctctggaattgcaatggcttccaagagcccttctacaagttgaagggtggctgcatgtcctaggtctgggaatattcagacatgccctcatccaactctttaccaccagtggtctcagtgaactatccaccaaagcccaagaacctgcaatgggctttctcggaaagctccaacccacacaaacctggacagggaactgcagcagcttgtgccagtgctaaatatgttcgggagggtgttggttcaggaaactgatgcctggccatctcaggcaaaatgaagaaaggggaagaaattgctttgcaggctggggaggtaagaattttaaccttcatgtcccaccctcctaacccaacctaaccaagatctctgcgattcacaggaaaggaaagacctaaatataactctacccacaatggtactgaccagtcctcagtgtgaccctataattaacgaagtaggaggtctccagatgggtcaggaccccctcagagtaagcagggcaagcatgagcctgtattttgagagaattttcatattcagctcatttgtttgatttttcagtggtcagtcagtccaatttttttctttgtaaatgcagtcattttgaatgtgtggacaggggtgaaaaggtttttcctaatttaaatgatggctagctgggattataagaattctgcaaaaacatctgtcttttgctatttctttccttgggaagtgatttgccaatttcattggagaggcagtctcttccggttctcacactctgaaatctgttctataattcatcattaggaaatactagctatgtggcatgtgaaggaaatatcttctgccttgatgttcgctggcaatccacagaagcattcgctgatgaagactgtgctgcaagatgcaaaactaagacaattcagataaaagttcatgaacagcaaggtagggaggacaggaaagactttaaaaataaagcacttagaatattaatgcaaacaaaagcacaatccatgaacttgcttgctgtcttcctcattatggacattgattcttcacctgtcttttctccctgactttctccccaggtttgtgaattcaagtcccagaagttttaaggtaaaattcacagcaaggacagcttctacatgaacaggtgacccttcaacgagaagcatgctggccacgaactctacaagaagtgcctccagactctgtgcagagtcaggaaccagtagggagaggaaaacctgtaaggacttcagtggatttcatttatcagatataaaatttagatcgattacagaacagcctttgtaccaagtttagagcagtatttttaaaactccccatcaccaaattcctctaatgaccgaacttgaacatctattccccaggaatctaggtacaccttaaatggcctactatgtatatgaaatacctttgtagtcttttcatcttagaactgtatggcaatttttatttttatcccataatacaacagtttaatgttttgcaagaatttcacctccctacaagtttctaataagactgaagctcagagaacgtataccatgttatacggaggcattacatccacctggggcttttgtggttgtaaacaaccaaaattgagagggccaagccagtaagttgataacagcttgtctctcacttgcagtttccacatttctctaccacccattcccatcatttataaaaccctatggatccttcaagtataatattgttgtcttccatccttccttttagatctccaagaccacaaccccagttcaagttctctcttgcctcactcctgtgaatcttgcctaagccctttgagcacaatgttcagtctcctccatttcaaatttatcttcctaaagcagagccaaaaacgttgctcttccaactaaacattttccttgggtacctaatgcctaaaacgtacgaaaaaattcctaaattcccaaggttctactatggaagtctgataaattggaaagaggatgggctcttggagtcagaggccttaaatctaaagctctgctcttctgctgactaaccaagtaaccacacaacatactttccccttagtagctataaatttctcaacagttaacaaaaaggcaggggagagatcatatatatatatatttgcctcatactgtggttatatgattagaaataatatatgtagaggacctacacataatcggatcacaacatgtactcaataaatggtaacaactactactactgctcctgctatgatatctactatagctactattactactactactttttaaaaatttgattccaatcaacttttaaaatcttttctcccactatttgccctcatttctaatattctggcaaaacttaattcactttctgggatatatttaaactttctaattttcttctacattcatagcctcaatcttcacccataattgaagtcaacagatcaaaaactatcttgcccacaaagctgatcatctctattgaagctattcttgtggctccttgcctttcagtgttgcaatttccatacctgttttatttgttgacccactctgtgggctgcctaggaatagtgactctgtctaacacactcttgtttctcctagagtagcttatacaacttaggaatttgagtagtacttgttgactaaagattatcttctgtagattacatctctactccttctgtcatgtgaaacaaaagcatagaccattacttctaaaatcaacctttgagcacaaactttccatcaaattaaaaggacctgaaggtttttccatctgtccctgagtgtcaagttagtacagggccaggagcatatagcatggctcctgtcttcctccctagtgttttcatgatgccatcctgcatcctagctgtctccccacaggatgagtgaatcaggagtcatctgtgctatctgagaaaacagtgactgctacacctccatcataactagtagcaaacctgattagtaaggtatagatttctttctcgcttgctcttgctttgtgtgtgtgtgtgtgtgtgtgtgtgtttgtgtgtgtgtgtgtatgtgtgtgtattaaaaagttttcatggctgggtgcagtggctcacgcctgtaatcccagcactttgggaggccaaggtgggtggatcacgaggtcaggagattgagaccatcctggctaacacggtggaaccctgtctctactaaaaatacaaaaattagctgtgcgtggtggtgggcgcctatagtcccagctactcgggaggctgaggcaggagaatggcgtgagcccgggaggcggagcttgcagtgagccaagatcacaccactgcactccagcctaggtgacagagtgagactccgcctcaaaaaaaaaaaagttttcattatgggccacgcacaatggctcatgcctataatcccagcactttgggaagccaaggcaggtggatcacttgaggtcaggagttcaagaccagcctgaccaacatggtgaaaccccatctctactaaaaatacaaaaattagctgggcatggtggtgcccgcctacaatcccagctactcgggaggctgaggcaggagaatcacttgaatgcaggaggtgaaggttgcagtgagccaagatcaaaccactgcactccagcctgggcgacagagctaaaaaagaaaaaagttttttaatatggaaatttttaaacatccagaaaagtgaagtgagaaataaaattccatgacctcttaccaagcttcaacaattatcaaaattttgctagttcctacttttttataaaattttgtcattctccactttcttttgcaaaatgaaaaacatttggacatttatttctcaaaattgtacacattgatagaattatgttaaatgcacacatatattgaaaaataaagagtcattagaaggcaaaattcctacatgttaagcaaagttctgtttggttcctttcttttttctgtttagggtgaatgctttataataagtatgttctagttcaatgatggaaatataaagtaagaaacgaaggtgaactatggaagcaaatcctaaaggactctctctgtaaactcacattgcagctctcctcgttgtcaggccggtgaggcaggatgaaggaggacacagagagagggccgtcacacttgtcggcaggctgagtgaaatccagacagctggtgatgatgctgtagtagtgagttggaacaggaatggaactgccttccacgtacctgaaacaggaaggtaaaacgaagtcacagttgatgagttgatgttgaagctttcttttttaaatggtgatcaatgaatattgcctaagtcactaaaattaatccccattcaattgaatcatttttcacttctaagcactagcccacttctatgtctttgaaaataatgttttctttgcctggaatcccctcactcctcaacctggcagagtaagaaagatattccaggcaaagaaaatggattgatctaagaattggagacaggtaatggtgaatagaccaatgcagtagaaatgaaaggctggaagcgtcaataaaagccaaattatggtgggttctgagtgccaggatatggactggggcattattatttaggtagtaatgctccattaaaggtttttgtgctagggagtgtcattcattattagttccatgtttcaggaagataactttcctagagttgtataaaatggacaggggcaagagacattagagccaggagaataatgaccctttcaagctacaatgagatgcagaacttgatacaaagaactcatttgccaaaggaagtactaaggaccgagtgctaatgatggacctagaggtataaaaaatattttcctgtagagatcagtacagaaattcataattccttgcctggttttctattatcttaattttattcattttccaaatattaaaattacgatttaactactaatttaattttggctaacagtgatcagcaataaaataaatgtgcaatttacacaaaatttctcttcagaatgactggaaaagaagtaagataatttctatcttatttatctgtatttataaaatagcaatttattctgtaattatctctaaatcacaattaaaccctcttatactctgggctgctgattgtttcatgcttgtataaaattaaataacaacattctgaatttgtcaacaaatttgttgacaaattcagaatgttgttatttaattttatacaatgaaaatacatcccaatcactctaaatcttgctttctccactagactgtggggtcccttatgagcacagataatggcttttatatgcccaacagcaccaaagagacagagacaaccagattcaatccaagtccataggcactttgctactgagaggtactgactcagaaaatctaagggattcttaagtcccacccaaataatgaagataagtgggaatggtcatcttcccattgaagagctgttgaagaaatgactaaacaaaattaaatcctttaatacatttttttcatagaataaaaaagtgcatttatttaccacaaaacccaaaattccattcccaccaccaatgcccatttaatcaaaagaattgataaattcaggctgggcacagtggctcacacctggaatcccagaactttgggaggccgaggagggtagaacacttgaggtcaggagttcaagaccagcctggccaacatggtgaaaccccgtctctgctaaaaatacaaaaattagctggatgtggtggtgcatgcctgtaatcccagttactcaggaggctgaagcaggagaatcacttgaacccaggaggcggaggttgcagtgagccgagatcacatcactgcagtccagcctgggcaacagagcaagacgccgtctcaaaaaaatatatatatatatatattgaaaaattcaaaaaacttaaggggtgtcatctcttctctagtatatgaatatttgaaaaacttcttgagtgagatcttgggacttaaaaatcacacactgagtagaaatgaaacgcttactgttttattttgtcttctgtgtcatgtaagccatcatagtcatagtcgaagattggtccacttatcacgttaactccatttctttccgaagcatatttcttcaccaataccctttggaaataattccagacccctgtgcaaagacaaaaatccaaaaatcaattattcatgaagaaaactccttactctagccaaattctctctaggatgcatgctacgagccaaatctcacaagccaagagacaagagagctgtcgtgattcatgagatgaatcaattctatggcattaccagtgtgtgtgtcatttacaaaccagcaaagggaacagtgtagagctatgaaacaatggtaggggagtttaacgtagttcaaaagtcaggaaaggatcctcccaagctgagatctgaagcatggataagtaggtggtgtttcccaggcagaacacgccaggcagagggaacagaatgtgcaaaagaggaagtatggtgtttcagagtaatgaaaataaggccttactctttcttctcgtccttcatatctcatcaatatgctagttcccaggtttaagctttacccctgacctttcctggagatccagacatgttatccaaccacctacctcctaatgcactggaatacctaatattcatgtcaagcaaaagaattttaatgttccttcctaatcctgccccaaccctcgccttctccatcataatcaatggctctggcactcacccaggtgtttgggccaaaagcctaagagtcatccttgctttctctcctagctatagacacatgtgaacaattcctgtcagtgctatcaccaaagtacatcccaattatcccaaatttgaccacctctcatcttttcactgctctatcctggtctaacttaccatcctctctgagtgagctatcacaccacaaaagactattccctgggttccctgtgaaatgcttacttcccttgtaccttgtagcccactcccccatatcgtagccagacggagccttttacaccataagtcagactgtatctttctcttgcacgcacatgcacacacacacacacaccacccatttccaacactccagattatttttcattgtaattagagtgaaatcccaactccccaccatggtctttgcctacctctgtgactttacttcctacccctttccctatcactcgcaagactttcttcctgtcccctgacttttcccctaacttatttcaggctaagcttttgcacttgctctttccttcgtttgaaaaacattcctggatctgtgcatgtctgctttctcctctataattctttctcactttcactgtcatcccctgcagagaactgccttatcctcctgcttctaatttccataatggccaaccagaggggcagaatggaaatggagaaaaacaagagaataacagaaggagacaggataggcaagcaatgggttggttctgaaatattagatcgaattcgccatgctgtcttcaacatgggtgtcatgcggttctggctgttaacccctcttccctccccttattaaaaagcacctggccatgcttctcatactgcttcaattgctcttcctgccttctgaaactctgaatggcagagcagcccacaagagccaaaataccttagataattatttgcagtcaagaaagaagccagacagtaagaaaggagttcaaacgttaacttaagcattaagaaaaaatggagaggaagagaaggaaagaaacaatgagaacagtcaaaaggccaggcctgcagaaatgtggcatgtgaaaaaaccacccccctcgtggagaacagcaagctctctatgaaaggccttctccacaccagcctcagggtggtactgtgtgttgccttgattaccatttggtcaaaaaaacacatcaataaagaataaagaaatccagagaaccctgatttgcagaaattaaatgaagctgcattctatgtaatattgtgataaatgtaactatgtgagtttctgaaatgcttctcagttgggtctgagaacaaaccaagaaatctttttaaaagcatactttaatttttcactcataagcaataaattctctttgaataaaccttcgtttactaactaggacatcaaataaacatttttttctctaaaccgtgtggcccttttcaccaatgttaagctgcggaggcccgccactgtagctgacactccacaatcgcccattcctattttgagactccctttcagccctgagagttacataacacagcctgaacctcctccatcaagttgaagcacatagaggtgcttccttttcctacctttcccataacgatttaagttctgttcactacaaatgtactgaaaggtggtaaaagctacttcataatgcttactctatctttgaacacatggatagataaaaggatggatgggtggacagggggatggatggatgaatgaggatggagacatagatgaatagttaacagaaacaaaaaatgcagtgctttcgacattggataattaagtcagaaatccatataaaccttagaggtcatgcaatcatatctcttaatttcacaaatgagagatttaatgacatttctatgatcacacagcctgtggtcacactccaggaacttggctttttgtgcccgagctcattgtgcctatacaattcttgacttcaccagcatccacaaatatttatgtcaggtacaaagaaattacaaatgttcaaagaaactaaaataattggtacaggactaaaatcatctgaaataaacactctgatgattcagaaggtcctttcggctcttgctgggtttcagggccaacattcagaaaatgttatcaccccaagaggaagaggtgctactggcttttactgcaatgctcaacaaataaatatagatgctgttaaatatcaagtggctttcaaaatatagtgaagaccctttttaaccattaagataataagtattgaaataaaaataacaaccatattagaagaaaaacacaaacttgggttagttcagtttctaccatgcatgacctgtggtcactttctgtgatatcaatttcttaattataaaccggggataaactaccagccaaccttcctcacagattcaaattttggatcaatgtagaaagtttacatgaaatcaaagtttacatcaatgtagaaagtttacatgaaagatcctcaaaaattataaaggttaaacacatgaaaagtattcttattaaaattaacagaggtagaaaaggtaaggggtaaatttagaaatgtttattttcataaataacagtgtattaggtaaatattggacttacgtttgaaagcaggatacattggaaccatattggttacaaggaatgcatcatatttagcctctggtgaagagctcagatctaaacattaggaaaacaaatagtatacgttgcttaccaaaatctatatcagttaaaaaaaaaagggagaggggggtagaattttcttaaatggtccaaacaacatgaagtaaatgaatctactcttttattcctactcctaactgcgttatacaacatgtccttactcccctcccactcagtctcttcttcactcaatagctctctcccaagagccatttacaatgtttttttcttactgtctacttcttgagtctaccaacattatgtaaaataactccttgatttcatcagtgccatttagacttaaaaaaaaatcatcaaggtaatgagagatggtttaagggcttcagatttttttttttaaatatggaatcttgctctgtcacccagggtgaagtgcagtggcctgatcacagcccactgtagcctcaatctcccagatttaagggatcctcccacctcagcctccagagtatcagggactactggcgtgtgccaccagctcagctaattttttaatttttttagagacaaggtcttgctatgttgtccaggctcatctcgaactcctggactcaagcaaccctcccatcttggcctcccaaagtgctggaattactttgggattacaatggtggctcatgcctggcctcaagcaatcttaagagatcccctctatagtattacataaacgactagtgtcttaatgattcactgtttccttttcagattctcatttaataatgtaaggcgggacacagaagattcccttgcacattagaattcccctggagaattagatttttttgaaagctagtcactttttggctgattttggaaggatcccataaaaattcatttagataatcttctgagcaccctctcttgaagaaaacccaagccactgaaattccaaataccaagattgcacaatgtgacatccctctgaaggcatcagatcttgatattcttaacttacaaggaggaaagaggaatccgtaggacatctgcttatcatttttgtaggccaaacagttctgactgaaactcggagaaacacggacatcaggccggacgcaactggtcagatggtcaggaacgctggaaacctcagcctgcacgggagtcagaggcactcagcaatgccgtggctctgttacgaacggctgaaatcaaaacccctctggcttctcctatgcttgtattctgattgatagtctgactccttttttaaattttttatctttgatagtctgacttctttttaaaagtccttagttttaagtacagtaagccacaagttttcaaactttttttaatcaacataactctctttatcaaagtcttaagaaaaacaatatagaaagcagaacataaagcagaaatcccactgttgaaataataaatagaatctcattgaagataacttataaaataacactcttacaaacaatatagatgtatctcctctaaatagactatttatctgtgtgtgtgtgtgtgtgtgtgtgtgtgtgtgtagaatgtacaagaacatacgtatgtgtacacagtacaaatcaaaataaactgtatttggggcagtagaagtgttctcctcctttgtattaaaaaattttaaacatgcctcaactgccaaataacattttctaatttgtgatatatacctatttatctcatcttcatcaaaactgaaacccccaacataaaacttttgttaaaaaacaacagggccaggcgtggtggctcatgcctgtaatcccagcactttgggaggccgaggcaggcagatcacctgaggtcaggagttcgagaccagcctgaccaacatggcaaaactccatctctactaaaaatacaaaaattagccaggtgtggtggcgtgcatctctaattccagctactcgggaggctgaggcaggagaatcacttgaacccaggaggcagaggttgcagtgagctgagatcatgccactgcactccagcctgggagacagagcaagactcggtctcaaaacattagaaaaaaaaaaaaaacagatgctgatagtgggggaggttgaaggggggtgggtgagtatgtgggaactctgcactttacactcaatcttgctgagaaataaaatgtgctcttaaaatataaagtctattaaaataaataaacaaaccttggcagtttctgtaactattgggcaatgacttaggcagagtaaaagaaaataaaagaattagtgatctaccttcaaagtttaacatattcccatggaattaccagaacattgaataaaggctaattcaaaatatcttacaataaatccaacataggatttctgtcattaagaaaaaataaaatattttctaagacaaaattctgttaagcaaggaatcattgtattaacatgaggaatgtaataaaataaaaaatataaaatccaattttctcaatgacctgtttggaaacagtatatgatgtccagagtggcattaggaatatttcactataaccactttcaaagtcagtgtgatataagatatcatatctagtccgataaagcactgcaggtcgcccatagaggaggtgtctctctaaaaaagaaaaaaaataaactgtgttaggtgcatattaaattttacatcaaatgttaaagaaatgttggaagagtcaagttacctaaaatggctagcttacttattattaatatagcaccttctccttaatttaatcaagctagttttcctaacacttttgtggttgatctgatcacctaaccatgggtcaagctttacagttatcaaaaccataatgtaaatgctgtatttacagaatgctttttttagttgtaaagaatttacaatttgtatataaaggaaacattatgtaataaattttgaaatgattcagctgaatggaaagccaataggattggatttctgtagaattaattattttgacccctgaagaggcttatcaggtacaccaatgatttaattaagaagaaggcacacattgatcattatatgcatacagcaactcaaatatgcattccttcagcataaaaagtgagtagtaatgagcatttaaagtaagcagctttgtcatacagaggaaaagtctttaggtaagaacttaaaggaacatgtatagataaaataagtgggcattcaagagggtcttctaagtacagaagagggaagttcatcagttaccaaagaactcaatgaagacccccagtgcagattcagacctccaaaggaaagctctcttcttaggaaaaaaaaaggtctgaagctttactctttgcggaagaagagatgggagttcagtatgaaaatcttcattccacactctgcaataaatacctggagcttgatctgcccactttggataggctaaagtcaaaacttccacagattcttggaaatgtggggccctacagaccaaaatatttagagactgaggcttaggcaattcacaattccttaagtgataaatttaaaaaaaaataaattcttgtactattttttctactagagaaaatcagttctgaaaaacacttattaaataatgtatacatgttgctttaattaaagtcttaccattctatgcaagtaatggagaaaagtcttcgtagaatactttgcaagaccctcccagatagaactgcggatttgagacaaagcggcccacactattacaacacaagcctgttctgggtagttcggctgctccagcattgcagtaaatgtagaagccttagttaagctgccaaatttggggacccacccctaaggattagaacataatctgacaatattaaataaatgaaatataataaacaaataaaacaccagcaaatcgtaacagtagtacttaggggcagtaaaacaacccagactttccttcaaaactcaaaccaaaccttttctaggttcaaaatttccattaatgttttccttgttttcatttctgctgcctctgaatttcctggtttcagctggaagcagaagtatcaaaattctttgagaagctattctcttttcatcatttaagttttcatggttaccacacacagtcctccaaactcaaattcaagcttggcatctaatcgattccattaggggacaataaaatagcagccatgttcccatacgcaatacccctccctagagcaaccaccaaacaaaaatcttggacaatctatagtctctactaactctggctcttcctctaaatcctcctcatttctaagcattcaacgtaacactctattccacaaaggctaatgtatttgcaacactctcttcacaattgttgttagcaacattacactatcatatatgctatttcctttctctctaccagaaataacttctccagtcttcgccaagtctgtcacctatctccttccaaatgtatccattattcttcatcatcaaacattgagcgccttggttgtgccagaccttgcgctgtagaatggaggtactgggcaaagatgattaagatagagctcttaccctcaaagagctcacaagtcaaagggagagacaaacatagcacaaataacagatgccatgtggtctgcaccatattaaagatagttacagagtgtgatgggaatgcagaggatgatgaatactggaaatggagtgaaggtggcatcaataaagtcctttaaggagcatatgaagttaaaccaggctggccccatgttacagttttatgcctgttgccctggtataattgttaatagtgtcccttttcacgctcaaaagtgtatgacaaatattcagccctcatggaagagacatgaagaagaaagggcgaggggcccaagaggggcagagatatcttaagattcattttctctgccgggcatggtggatcatgcctggaatcacaacactttgggaggcaaaggcgggtggattgcttaaggtcaggagttcaagactagctggccaacatggcaaaaccctgtctctactaaaaatacaaaaattaaccaggcacggtggtgcgcacctgtaatcccagctactagggagtctgagacaggagaatcgcttgaacccaggatgtggaggatgcagttagccaaggtcatgccactgcactccagcctaggtgacagagcgaggctccgtctcttaaaaaaaaaaaaaaaaaagattcattttctcctgaaaggtttcctcaataaagcttctccatctctactcactctactgctctacatatatagattcaacttgcttcagaaatttgggttctggccaggcatagtggctcacgcctgtaagcctagcactttgggaggctgaggtgggcagatcacttgaggtcaggagtttgagccagcctggccaacatggtgaaaccccatctctactgaaaatacaaaaattagccaggcatggtagcacacgcctgtaatcccagctacttgggaggctggggcagaactgcttgaacctgggaggcagaggatgcagtgagccaagatcgtgcgactgcactccagcctgggcaacagtgcaagactctgtctcagaaaaaaaagaaaagaaaagaaagaaatttgagttccatagcttccaagctattgtcataactgcaagttttggcacacagctggaacacaaaagtatcactgactgcctttttctcaattattactgagcaaaaatagcataataaggggaaaaaatacagtggtttttacagcctcctaaaaatccaaccaaggtccccaatgacccaaaaaaatctacttgggtcttcctggagcttaacagtttcatctaagaaagagggggaaataatctctgcagtaagaaacacagattttaaggtccagaatcaaaatttagattttattttttcagtttatcaaagtatcaaagaatcacagattcagagtcatagcctgactctcctagtctttatgacatcttgggggagccacccactgcatttttgttgagcaaaaagtctctctactcaggccacaaaatgtacttgaatcttgttctcggcacacattgagatctttatctcgagaccagcaaccctggagactagcctgcaagcctctgcttctgcaatatgtttctgggatttcttcacgtggatctagtataacctggtcttcccaggctgagaatgcctgtcatggaattccagaccgagccttcattccacaccccagttccctgtttacaatagtgtctctggcagttttggtacatgccaaggttctcctccagataccacacttggcaaaatactgtgaggccaatctttttaagtggtgtggacttccccagcactcattctttttgtattccaaatttgggtcgtagagactggagtttgtgttccttttccctcctcagcttcctgattcagattcccacagatgagcaggctgtcttgagagccacatgaaaatctctcctcttttttgtttttttaaaacatacactcccacaataatatgctcttaaatcttaccacaaaatctctacccaagatctttccttttcttgcatactttctcctttgccttacaagtgcctattatcatttgctgccatttcaacctcctctgagatttgatttaaggcctctctttagtgccctgttctttcttaccccaaccttgaaaacattatgctgtaatgtatcaactggataaatcctacaacagaacaataactttatgaggacaaggacttcatctgttttactcaccactgtatcttccatctccaacaatgcccatcacataatatctacttggcaaacacttgttggtaagttaatgatacatattttttttaaatcttggctttctacatatgacctgtctaatgttaccctgaaaggtacactgggcaggtcagtagtatcatctccaacttactgatgaaggaactggaggtttatgatttgcacaaaataattcagctgcatagcagcactagaatcccaggccattactcttctgcttggccttttgggtggtctccagttgggtgctggccgctgggttatttcatggagagtgtatgggaaagaagatccaactacttcccggcaggaactctgcccgagtaatgcctactgagaagctaatgaggacagtagtttctgtcaaagcatctagtatttcagaagcaacttccaaactttgatatacaaattttttgttgagcaaagagtctctctacttaggccacaaaatgtatatgaaaagcaaaattttcttttgacatattccctttgttcccactcttagaataagaagcattttcagatgaaagcacatgggcttcagtgtcatataaaactgcgttcaaatctaatctcagctctttatagttgtggtactctgtaacttaatctcccaaagctttatatctccctggaatgttgcactgtttacaggcaaaatatgtgaagtggcttgtttagttttaacccaaagtaactgcagttgtagcagttgcagttgtactgtttagtaaaggtatgggctctacctcaatactggcaaagaatattgctaggtaaaagttgttaaaattcaatctaccatcaaattcatcttgaattctactataaacaataaacaattactatgtattgatttcttccaagtattcccaaaaacacacagatacacacgcagacacaaacactcagaagcaggagtgaatgctatctccttctttctctagaacaactaatatctccaaagaaataacacaaatgagaaacattccagaattgacaagagctaaagaagatgttccctctgtagccatattcaggactctgctttaaagttaacaagaattactagtgtttaagtcaattttctttttcttttttgaaacagagtttcactcttgttgcccaggctggagtacaatggcgagatctcgactcactgcacctccacctcctgggttcaagcgattctcctgccccagtctccctagtagctgggattacaggtggatgccacgatgcccagctaatttttgtattcttagtagagatggggtttcaccatgttggtcaggctggttttgaactcttgacctcaggtgatccacccacctcggcctcccaaagtcctgggattacaagtgtgagccactgaccgcacccagctgtgtttaagtcattttcctatccaaactaacttctcattgtgtatgataaggagccaagtatacataggtgttaaaattatttttaattcctttttcacaaagatgatggtgagggctaacctaagaaaatatgaaacatttttatagcaatgtaaatagagtaaagaccaaggtgaaaataaatggtgcaattattcttgcagtgaaaattatacttggctatagtgccagaattgcttgctacaagagattttttaaattttcttttcattcattaattcatccatcaattcaatgccacaaggaaatgagttttcattgcatggaaagtcggccaagacattaggtatatgagatccagaaataacaacaggcatgcaattaagacctggagtctaccacctatctagaaatattaaagtttagcaagcagcttagatggccatttttgaggattacatttttctttctctttattttagtaaaggatttgattccataacagtttaaatatttatagcaaaatattgcccaagattggtttaacatacctcttttttatcacagatatccctgtgatcgtttcactattggaacatgcagcttttactcatgtattttgtacagatgtatgacagattttacagcatatgccattaaaacagtcacatataaatgttacaggtgaagtgtgtatagctcatgacatattctgaaaaatatcaactacttacatctgtgttttaaaaaactaataataaaaatagtacaactttacatctgtatagaagtttaggtttacaaactactttaaaagccttcatatgtattcaaaggtacctagaaaggggaagtaattgccctgaacataatacatgtgtgctcacatacatggtggttcacattcacaaggatctcctccagtagggcagacactgaatattttaaatgggaggccaaatttatgacacaggaaacaccataaaggcctgaaagaactcagaccaagaaaacatcgctttgccactgaagaaatgaccaagatagagcccaaaaggaaacaaagcccaagagacagcgataggagagagcaacaggagaaagagcattgaggtttatacatattccagcatctaagcaaggaaatgcattgcacataataagacaaatatttttgaaggctctcttgtgtcattaaatgttggtgccactaggccatgagcagacttagaatagcatgagctattctagattcccccctaatattttatgccaccactttgaagccatgaattagaaactctcagtggtacagttgtgtcagagtaaccagtgccagcccagtgtcagtattcaacaaatgcttgctgaatgtatccatgagggtttgtttccatgaaaatacacaaactttaagcttcagcggtataaaaagacacttcagggatttaagtaagaaactcacgttccactcagagcagagcaatggagatgtaaccttactaactatagctccttatagccctgagagtcagtgattcactaagaagatgtgtcttatttttatgctcttaagtttgaggtgattgtgtgtgtttttttgttgttgttgttgtttgtttgtttgtgagacagtctcgctctgtcgcccaggttgcagtgcagtggtgcgatctcagctcactgcaacctctgcctcccaggttcaaacaattctcctgcctcagtctcccacgtagctgggattacaggcacgcgccactgccgcccggctaatttttgtatttttttagtagagaaggggtttcaccatgttagccaggctggtctcaaactcctgacctcaggtaatccacctgcctcagcctcctagagtgctgggattacaggcatgagccactgtgcccggctgaggttattgtttataatgaattgtgagactggttttgtcatataaggacactgccaccaacaaattaaatgcaggaatgtttttctcagacagaaatgctttagtaccatgaacagtcagactttgaatcagcaaaatcatgggagttcaatagaagttaccataattaatttcattagtgacttttagaagagaagcatctgagtagtatttatctgccttggcaactaaatatctaaaaaacttgaatcatgagactccccatcttttgactctagcaatgttctaattgttctaattataatgacactatagtccactagaggttaggtgtcgaacattgcaaatcacttgtagagtttgtgaaagatttgtgtgccttctaccaacaatggcctatcttcaaagtgagattcattccgttctgtgccagagtctgtgtgttctgtgatcaaagggagaagtgggatgatggagatacagaaaaggaagaaggaggcagatgaagatctttaaaagaggaaaaataagtcaagtaaatcaaatcttctaccggtttcctcaactctacttaatcagattggaaagagcatatatgataaacagaaccatatgtaagctaataactcaagcgatgctctcaggagaatttgaccacgtgcatctttgctgcatgacttgtggctgctatgcttgaattctttctgcattttccatacacttttagtcatttcctggctgtttcaacatgttatcccatctactttagtaacatgtataggaggcttcccctccccttctattttcctccaattttgtgaaacttcacaatcagataaaaagagcctgcatggtagattgtgttattgctcctcattatttactgcctccacccattgccatatgacttgcaggatagagtccccgtggaaaaaatgtacttccctacaccattggtatcatgtgctcagctttggccagcaaactgtgaatggagtgacatatgcctcataaaagcagaagcattaagacacagtgcacagttctgccactcttttccctctgtcaagagcaggacatgtctctgatgaaggctactccttcagcctgggttccagaataaagaatacacatggagcaaagctgcccttggcctacagccagcacactaaaatgggagcgagaaacgcctcttagtacaaatcactaatttttttttttttggtcatatcataagcttgcgaaagttcactaatacgtgctcgttatcattgtacgtaaagtaagagttagggcttgagatgatccttcatatgaggagggagttctgatttgattccttcggtgaatctctccctatcacaatatatatatatctatatatacactgactctcgaggtagataccttcaggataggcaccagctgctattatttatcattgtgactatcattccctttataggagtgccccacagtgtcttatgactcatcagatacaaaatggattgtgtacttttcagagggcttaaaagctattgaggggggagaaaagctattggaatttttttattacacagctggcatcttgtgtacatggaataaacaaatatcctttgccagataggtatgaaagtcactttgaaatacaaattctaattttaaacaatattgtgcttacactataatgtaaataagaagccttttcgattttcgaaaacgagaaaaaccttatctgattattttgcaaccaccccttaccttctgtagacccttttgtatgaagccgtttgttgagttcatccaacttgttcttcatgtgtgaaaaccagtaaaggaaaaaagaaagcaaatcagaaatgttctttccctctgtgcccttctgtcgacttagcaccctgctaaattcaaaagcgaactctaaactccatctatatcatacattctttcgaggaattaactgttttctctcaaactgacattctgggctccacctctagcagttctatgtttgtaagcaccttcttcaatctctgtttccttccttaaaactgtggatagtcaccacagtaccaatttcccatgtgggtactgatgatgacttgggcatatatgtgtaagtaaattaggatagcgcctaaatgtttcagattaatctctaggcacactgaagtgattcccaaactaatttatgaaatcacttttcaccaaagctaaaacgtaatgactcagcaattctgaaacagcatgagtcagcaactctacccttcactgtataccctagcatatgcgtgcaagaagacatttccagtaatgtctgtggcaacattgttgtaagagctaacatttgcaaattactaaatgttctcaagtaggaaaatggaaaaaaattcttatggtacatttatacaattaaatattaactactgtattagcagtaaaaataagtgagctaaaacttcatgtactaatatacattaagtctcaaaaacataatgataaaataattgcaggatacatatagtataatagcatttattaaaaattttacaacatgcaaaactatagtataggttattttaggaaactatacaaaagattacttcatacgttatttaataaatatataaggccaggcacagtggctcacgcctgtaatctcaacatattgggaggccaaggcgggtggatcagctgagtcaggagttgaagaccagcctggccaacatagtgaaaccccgtctctactaaaactacaaaaattatccaggcatggtggcaggagcctgtaatcccagctactcaggaggctgaggcaggagaataacttgaactcaggaggcagaggttgcagtaagccgagatcacactactgcactccagcctgggcaacagagcgagactccatctcaaaaaaaaaaaaaaaaaagaaaacctgtccaagcatagtgtgtgggggtagtctctgtttgcaccaccaccgcatccttgttgcaccctcccacaccctgctctgtggcctgggaggctgacctctagggatggcatcaaagagcaaacttgccctgtggctccctgttgggctctaccaaggggaaacatgtgaaaggaagtacaggggaggaagatgacggtagcactctcctatctgggagtgctccctgctgggttgcaatgaacaagctgcactcatcggccaaatacaatagttccttcctattcggttgtctctccatgttttggaaacttactccttcccctcaccctttaaaccttagaaggtactatgcgaaccccagggcacttcgtcactcctcattgaattccatccaccctgctcagccttggtaaattactcattaaacatgactgaaacaattcctttaaactctctctttttttcatttccttttttttttttttgagtcagagtctcactccgtcttccaggctggagtgtggtgacacaatcccggctcactgcaacctctgcctcaagcgattctcccacctcagcctcccagcgccaccatgcccggctaatttttttgtgtttttagtagagacagggtttcaccatgttgaccaagctggtctggaactcctgacctcaattcatccacccatctcagcctcccaaagtgctgggattataggcgtgagccaccatacctggcctaaactctctttcaaaacctcttctatatgggccacctgtctcccgtcgggaccatgactaatagacatgtgatccacagttgaagaaaacagaaaaagattttggttgagaactgtgactgcacagaatagcaacatgaattctactttttgtctttcatggtctatacctgtgctattcaatatggtagccacaagccacatagggctctttaattataaagtaatgaaataaaaatttgagttcctcagtcacactagccagtagctaccattttggacagcataattatagaccatgtccattgtcacagaaagttctatgggccagcactgttagccacccaacaaacttctccataataaacataaagattatttctacctttggctctaccttatcatcacaagtgcagcccaggtcaaaatcagactgaaggtacataatccctggataattgggtctggtaacttcctctggcatggttggcctgaaggtattagtgcgcaggagatgattcaaacttccatgggtcccattattaggagctggcttcaatcccaggagatctaatgaaaattaagaaaaggaggcaggtgcttcttatatttttttgatgagatatggtaagatttaaaacccttcaccttctatgggtctgaaaactgtgaacacaaatcagaactggacaaaaccaaatgtagatggcaggcaccccctccttacctcctgaaccattctggactaactacatcttgccacagctttctgaaatacccaagttcattgcctgaccatgaatagagagagagagattcccagaaagaaagagtgaaggaacaagactttgattaactattgcctgtatctgcgatagttacaacccaagggtgatcaatgtcagtatcactttttcctgcacttctctgggactatttaattccatgttttgaaatgagacttataatcaataactaactagaagtctgccctctaatgactccacagaagtgtggggacatgaggaggctttggccctgtcccctgaagtgccactgagcaatgaacaggctgatttcatagcaagtgaatggttgccaagtgcgtattcagtaacttgcttgagctcagaggcaggacaggggacagctagcagccaagatgggaaaagaacccaggagacccgacttgcagactccccctctaaccaccagactggcactcccttactaaataggaaaagttgtcctcattcagcaactagaagttcaaggaagaaaaataattaagagcacataaatagctggccaggatgcaagctggcaacatttttaactgggctgcaatgcaagagatggaggtggaggggactctgtgcagaactcttgcttcatcaggtctctgaccagtggtgtcaaactgtaatgctatgttagaccagccagaggctgccaacagcaacactatgaaaacgccccattagtcaactgttgaaggaagacaaagaagccttagaaggggataatattctgtctttgaaccaatgggcaagttacaaccttttgtggggaagaggaggtagtcccagaaaatagacacctcatttctttctctgacattgagaaagatcatatatactaactaaagattgtttcaatggttctgattaaatgagtgacttaccacacataacattgtaaagttcaatgttttcaaatggaggcactttagtcttgtacttaaatgttgagccataacctacaaaaacagtcttccaaaagaaaagaaaaacaaaaacagttaagcattgttaggtaggaacccttcctctatttatgaatactgtacaacttcactcacaccaccattacttatcctttcgaagaaccactaaaacacaatttcaattcacagttctgccatcatacctgcatgctgttgaccttgttatcaaatccgtggtctccctggaaaaagcattttcctgatggtttcttataaacatccaaaggtttcctaaattgaaacaatttcatgattagttagaatttctcatgaaattactttgataaaaaggtaatttcagggtacaaagaatatctaagaaggggcttttgaaagtttgcctctattttaattgcattcttcttgtgatgatgaaaagaggatcctatgcatttctccaagtgacttttctttgacagttattgcaggataaatggcgacctgtgaactgaagtcacgatgccctccttggagctcgtgcttacaccaagtagggcacttgtcaaaagtcatgctctgcctgtctaggtgcttcgctagctctgagactgtaagattctcgactctaggaccatgtttgtctggttcacttctatgtacccctccctagggtcagtgtcaagacatagttggcactttaaaaaaatgtgatgtctcacctattatatacccataataatttaaaatttaaaataaaataaatttgcgatgtttaaacaatgaatggagatctatattctataaaaatatttgcatgcaaatttatctatcaatatacaatacaactagagtacaactaagcagccaacttaacagtaatcatgacatatctgacaaaagcatggtctcacctagacaatatctctatttagaaacagaaaacagaaatactgctctctagacatcaagaccatctgatctttccttttgtgacagaagacaccttttgcaaaagtgtcatgtgacccttttccaaaatagctttcatgttaatttaatacaaatatttcctaagtacctatgggtatatagcactgaaagtgctttgggaaaacaaaaaatctaacatacgggtctccacccttggaaaaataagggcttgggataataagacatatgcatacaatacctcaacaatgcaagatgagttaaatttaaaagatgcattgttaaccaacatgcctggttttgggctacactaatttgcccaactgtcatcatctttcacttaacttctactcagctcccatgtttttgccatatgaacctactacctgcgccagtgtgaccccttccaagctgccccatacataaaaggtccttcaggagcacataccgggccaattaatttcagtcacatcccaattaatttaccaggccagtaaattctccatgaggatttcccacaactgttttagaagactccaataattcctgttcttcgtacatctttcttcataatcccacatatctaactctaagtacaccctggaaaattacagcatgatatttatgtatctgtcaaatgtgtctctctaaacatcccatactgatacaagtttctagagttctaagttcttcttagaacttgagtttctaaatattttcttgttatcttctttctcttgcaaactagtacccagctagagtacatgtggcagttgttcaattattgagatagacaaattcacagcacttttcttaagtagaaagttggagcaagagtgagtgggaacagctacttccaggtctgtgtgaaaatggataaatccttaataattaactcattggaagttgttagagcctccagacatgtcctagaccacattcaaaagcaaggaacattctcttcaacattggagagtgttttgtagttcaatagaaggcaaacattgggaatatttaaagcaatgtaaaaagtgcccacaataacagagtttttaacattaacaacattttctaaagtcctctataaatattgctacaagcaaagtctcaacaaccgagatcaaatcagcccaatatactaaggcaagctcccatttatacttttgacttactcaagtagtaagaatagagtttagaatgtaaattcaaaggatgaaagagacacacacacacacacacacacacacacacacacagatgcactgacagactgcaaagagacaccacaatgctgagacccagaacatagagatatattgtctcagcactgatggtttatgtagcccacaaaatctttggaaacagtgagatttccaactgatatttctttcagtgatgactaaggatgataaaatatttccagttgccaaaggggtggttgtggaaatgagaaacagaaatagcccatataccagttaccttgcaacatgccatctgcgttccaccaataaatggatatcctcaattcttctgttgttggcatagtgcaaacgtttgggaaggtgctgtttcaagtaaggcttaaagtgctgatctggttttttacactgaaatagaaatggaaatcagacttcagatggaatgtcttttggaaaaattcttacaaattctctctctagaaagctgaaggagattttaagcctaaccaaaggttaatgagtgaataaatgaaatttatttctattaaataatgtatgctgaaaacaaatagattcaaaagagattaagtaaccttggagatgatatgacaggctatctgaggacagttaggaattttaagatgcattcctggcttgtgagaccatcgctaagagcaattcacactccaaggcctttcccaactccttcaagtcaagcagttgggggtggggtgtcggtgggaggggaggagcacatgggtttaggcttatctgattagatgctcttgtaccactaaggtcgctacccagcatccgggaacaatggagcagagtgggtgggcagttctggttcagggaaagtaaagatttgtttaaccatgaatgaatacttttcagttctaatggaaggatcagatattctccatttgtatcattgccaagaccattagggagcctgcagctgaccacaggccagaagttttgaaagttcttaaggaaacaaatatacaggatggcagggcagtgaggaaagtgttcctcccacccctccccgccgggggaggcacacacaggagggaggctgctccaggggcagaggcctgggcagggcagaggcgggacaactggaaacacttaccgtgagattggcaataatggctttggggtcatctgttcaaagagaggagaaagatttcaaaagaaataacaaccattaccaagagaaatcatttttgcagcaagatactcaattctttctccttccatcccacagaagactatcactttagtgttttgtttgaaagataaataattgtgtaggggtatttaacatttcagtcattgacatgcagctaagcaagtggaacaaatcctatagtaaactgccctcctaggtccagttctgctcttctggagggaattcctccttccatagcaccaggatactgctaggtaaattgcttcttgttttaagttccccctaatggttccccttgagacataatttatttgcagtttgacctcaggaactaaactgggcatttggggcttttaatgtaacttcttatttatctgcagatttttgaaacaagtcttcacccactttaagttgaaacttctaatccattgagttatttttttaaaagggagtttgtttccctatttatatcctgggtgtaattacacaggtagccgcacctctccagccatagacacacacgtgcatgcacctcctttattttcaatagcatcaagtaaaagattttagtcaatactctgaactagctaaaagcaaaattatgtaaatgatggctgtgcataaactgtggacaggattatattatctgaagctccccttttgggcggaatgtggggagaaagaggagattgtaggttgcttggattttgttttgttttcaggaagtttgcttcagtatgttattacagaatcagcagaaaaggaaagtggtgttcagaagagatagcaactatcatgaggcagccctccctggcatctaaataccagtggagcaggccttatctgtatcacgtgctgctgcatccctgggcctgttcagagtagacactcaatatacatttgttaataaatatttgttcatatttgttaaaaatgtatgaataaacttgccttgggatataaatatacagactccaaagtctattttcagaatcttagctctaaagcttgaaatccgaaactaaaatgtgtattccattggccttaattacatctcttactagaaggcaaataagtaataatgtaataataatagcccgaatagatttcatactatgtgcctgtctttctataagagctctgcaggtggccagatacagtgatgcctgtaatcccagcactttgagaggcaggggtgggtggatcacaagttcaggagatcgagaccatcctggctaacatggtgaaatcccgtctctactaaaaatacaaaaaattagccaggcttggtggcatgtgcctgtagtcccagctacttgggaagctgaggcaggagaattgcttgaacccaggaggcagaggttgcagtgagccaagatggagccactgcactccagcctgggcgacagaacaaaactccgcctcaaaaaaaaaaaaaaaaaaaaaaaagagctttgcaggcactttctctctggtcattcacaataaccctaggaggtaaatgctgttcaaatcctcactaagccaatgggttttcagaaggaggaggagttggcactctgacactcaagcaacctgattgagcaagccaggcctcataaatcatattcctcaaagggacgaaataaagtaagttcatggtctttgacaatgaagagaagtaaatagcatgtactcagataagtcccagagaattactaggaatatccaatgcctgagtccatactggggacatcaatccttcaattctgaagaacttagtctttgcaggctaacagtcctcattttgtgtgaagaaagggcagtggttcagctaatctggcttcaaatctcagatctgaaacttactaaccatcatcctcgaagctagttccctcacccctctctgagcctcaatttctactgtctataaaagggatagtgatacttatcacacaatgctattaaaaggattaaataagagtgtatgtgtatgtgtgtgtgtctctatctgaaatagtggtatgactaagacatcatcatcatatccaacctttatatagctttgactatgtgctaagcactgatctaaattatgtaaacacaatctcttgtttaatcttcctaacaatccttaccttgcagatgaggaagcagaggtacagggcgtcacatggtgagtaccgagcagagctgagatatgaacccagacatctgtgcctgtcaccaccccatgctactgtctcccacaaaatgaaaccacattggaaagtgtttttgtaaagtacaaaaatttttatcattgatagttatgaattcatgggccatgggaaggtttttttttctcctccaaaccaacctccccattacatgtactaatgtcagaaatattgttaaaaatagagaaaatcttttttgcatagccctgaagtgcaaatactaaaatcgaggggtgccatagtgactgcatccagtctatgcgagggcagaaaagggaggacacagggacaggaaaggtcatggaggagagagggcagaaacacccacattttgtttatttcacaacatggtctggagctgaccctggaacagttccagttgtgttgactcaggaacataattagggaaaaacttaattttccaaagctgtaaggttggtgtcaatggtttcttattcccaaggctaaaaactctaaagaatttttttttcaaagtgcggcataaccccaataaaactatggacttctcaaaagctaggtagacagcacctaaaaatcttagtccacaaattaagtttgtatcagtggtagatcataacctgaacatgtaaaacataagtgacaagattattcctgtttatttttatttctaatctttcaggacagctgccacttcccaagggcttaatatcttttcctactaggttctaccaatcacttttacaaagagaatggactccattccacaaggctcctaggaacccccacagtccaaatgtggttctgccaacccttacatagaccctctagtttcatctataaaaatgatcagcctgaacttcttattgaaaaaattcttatcttataaacttctgtttatggtcatgaatatgcttcaaactaagtgcaatttccacataataagaataagagcaaatatttatataatgctactatgtgccaggaaccactctaagcaatatgcatagattaatttctacaggtagctgctagcatttatcatccccatttttcagatgaaaaaactgaggcttagagtctaaatgacttatttaaggtcactcagctaagcggtagcagagccagaatttttacccaagtatttcagctttagaaaacaagcccttacctattcctttgtattaccactctaaccacttaatattttaagaatcaacttacatttagcattgttgctaaatttggatcgaattcttcctagagttccaggcactaaagtaatatcatccacattagttaggtaattactcaagaactcagttctatcacatgtgacatcttccattcctatggggagggagaaaaagaatattttcaggcaagactaaaacgaaaatcttaacatagacacgaaagataacatccaggcatctctttagttagtttttagtaacttaatgggaagagccctgacttttgagatttttgtatttgactttaaatggtttaaggcttctctgtataatcttttctctagacttttacttagccatatcatcttgcaagcactagaaggttgaaagtgcattacctcgattacattttaagtcactcagccagaatagcaagacaaaggaagtcaccatgatttaaacaacaacaacaacaaacataactattgacagagtctttatgaaaaagatctattctttaaaaaaaaaaaaaaaaaaaaaccctaggttgcatcaaactcttcccagctgggggtggtataaatggaatatacagttctgtgtctcttttacaaaatgtcattttccaactctctaatatatctcctgtcttgagtacataatcaccagtcctcactgtctccactggtggccttggatgttactgacaaaacaatactggcaacaagagatgagaaagaaaaatgtcagttccaatgaccacccaaactgaaaaacaaaataacactgaaaacaagttgtaaacaatgtaattagtcagaactgaaagctagcaactaaagcaagaaggttctaggtagggaatttttttaaacaacaaatatttctcctccaccccaagatttgttgtgtgtccccatcaaggaaaattcttttattaaaatgcttttatttaaaacattgttgtaaactcaaatcttagcatcatagactatggaggctactagagatcttattgaaatgtatgagatgacctggaacgttttaatatattgctcagtacaattcagtatgtacatattctctaacagggaaaataaccctgttggagaatactcatatatttatatcctgtaaaggatgcccaaaggttttaaaataaggaaatacaacccagagtaccccagatctggtaaaatttaactaatcacctcctaggatcccagatccagaaccttcccttgtttaatacaaattggaatgaaatgcaagaaaaaacacacagcataaggattatatatcttgcactttaacagttaaacccttaggaagaaaaatagagcaatgaagagctactatgttttagtacaatgttagcgtgggaagggaaagtccccaaatacctattaatagagggctgaaagtctttcccatttgttatatttctaggaagtcccttatgccaccccaaatgtgagcaatctcctttacttttgaagtccatcaggcactatgctaagtgctcctcaagcgtcatcagccttcactctgcagactaactttgtggaggggtgttaatgttctcacctgacagatgaggaaactgagacttgccacaaaaggtgtatagtgtcagatagctgttaaatgacacagtgcaatttgaactccactaaaattcattatgactccaaagaccatgccctaaaacactaaaccataccatcttttaagagagaggtgctgtacactttgggaggccaaggcaggcagatcacctgaggccaggacttcgagaccggcctggccaacatggtgaaagcccatgtctactaaaaatacaaaatttagccgggcctggtggcaggtgcctgtaatcccagctactcaggaggctgaggcaggagaatcacttgaacccgggaggtggaggttgcagtgagccaagattgcaccattgcattccatcttgggcgatgagagtgaaactccacctcaaaaaaaaaaaaaaaaaaaaaaaagaagaagaagaagtgctgtagttgtcccaaaccaaatggatctactcatcttggaagcctacacactgacaagccaaggttttaacctatccatgacctttacaatgcctcagcacatatcattgggacccttctacttagatgtctggctccagcatgtgagcaaatgctcttgacacctctgggcaacttaaattgaatcagctgtgacacatgctccaacttctctgacctgtgtgtagctctccactaagccgaatgcatggagcatgacttcgcaaagggttatatctagcccactcaagaggagaaagctaatccctttggcttttttttttttttttttttttttttttctaatttctcatagatcttctaggacattctggaaagaccttcaggaccagagctagggagatttgcctaccattcttaacagaactgccaaagagtcagccaattttcatcctccgaactccactagaagggagaagccccaaattccaatgct
